US008324455B2

(12) United States Patent
Puzio et al.

(10) Patent No.: US 8,324,455 B2
(45) Date of Patent: Dec. 4, 2012

(54) NUCLEIC ACID SEQUENCES ENCODING PROTEINS ASSOCIATED WITH ABIOTIC STRESS RESPONSE AND PLANT CELLS AND PLANTS WITH INCREASED TOLERANCE TO ENVIRONMENTAL STRESS

(75) Inventors: Piotr Puzio, Berlin (DE); Agnes Chardonnens, NH Enkhuizen (NL); Harry Wild, Berlin (DE); Gunnar Plesch, Potsdam (DE); Bryan McKersie, Raleigh, NC (US)

(73) Assignee: BASF Plant Science GmbH, Ludwigshafen (DE)

( * ) Notice: Subject to any disclaimer, the term of this patent is extended or adjusted under 35 U.S.C. 154(b) by 1596 days.

(21) Appl. No.: 11/663,680

(22) PCT Filed: Sep. 23, 2005

(86) PCT No.: PCT/EP2005/055024
§ 371 (c)(1),
(2), (4) Date: Mar. 22, 2007

(87) PCT Pub. No.: WO2006/032708
PCT Pub. Date: Mar. 30, 2006

(65) Prior Publication Data
US 2011/0173715 A1    Jul. 14, 2011

Related U.S. Application Data

(60) Provisional application No. 60/613,194, filed on Sep. 24, 2004, provisional application No. 60/618,738, filed on Oct. 14, 2004.

(51) Int. Cl.
*C12N 15/82* (2006.01)
*A01H 5/00* (2006.01)
*A01H 5/10* (2006.01)

(52) U.S. Cl. ........ 800/289; 800/288; 800/298; 800/306; 800/312; 800/314; 800/317; 800/317.1; 800/317.2; 800/317.3; 800/317.4; 800/320; 800/320.1; 800/320.2; 800/320.3; 800/322; 435/419; 435/468

(58) Field of Classification Search ........................ None
See application file for complete search history.

(56) References Cited

U.S. PATENT DOCUMENTS 7,041,875 B1 *  5/2006  Blumwald et al. ............ 800/298

FOREIGN PATENT DOCUMENTS

WO    WO-2004/092398 A2    10/2004

OTHER PUBLICATIONS

Miyagawa et al. Mar. 2000 Plant and Cell Physiology vol. 41 No. 3 pp. 311-320.*
Yeo et al. Jun. 2000 Molecules and Cells vol. 10 No. 3 pp. 263-268.*
Xiuyu et al. Aug. 2001 Acta Microbiologica Sinica vol. 41 No. 4 pp. 427-431.*
Jang et al. Feb. 2003 Plant Physiology vol. 131 No. 2 pp. 516-524.*
Bard M. et al. Cloning and characterization of ERG25, the *Saccharomyces cerevisiae* gene encoding C-4 sterol methyl oxidase. Proc. Natl. Acad. Sci. U.S.A., 1996, 93 (1), 186-190.*
Li L. et al. Characterization of yeast methyl sterol oxidase (ERG25) and identification of a human homologue. J Biol Chem. Jul. 12, 1996;271(28):16927-33.*
Van Camp W. et al. Enhancement of oxidative stress tolerance in transgenic tobacco plants overproducing Fe-superoxide dismutase in chloroplasts. Plant Physiol. Dec. 1996;112(4):1703-14.*
Whisstock J.C. et al. Prediction of protein function from protein sequence and structure. Q Rev Biophys. Aug. 2003;36(3):307-40. Review.*
Wu et al., "Over-expression of the bacterial nhaA gene in rice enhances salt and drought tolerance," Plant Science, 2005, vol. 168, No. 2, pp. 297-302.
"*Escerichia coli* sodium-proton anitporter affecting protein (nhaA) gene, complete cds.," EMBL Database Accession No. J03879, Oct. 4, 1988.
"*Escerichia coli* DH5alpha Na+/H+ antiporter A (nhaA) mRNA, complete cds.," EMBL Database Accession No. AY449719, Jan. 26, 2004.
"Na(+)/ H(+) antiporter 1 (Sodium/proton antiporter1)," UniProt Database Accession No. P13738, Jan. 1, 1990.
"Na+/H+ antiporter," UniProt Database Accession No. Q7BCH2, Jul. 5, 2004.
"*E. coli* stress-related protein gene b0020" GeneSeq Database Accession No. ADT87269, Jan. 13, 2005.
"*E. coli* stress-related protein from gene b0020." GeneSeq Database Accession No. ADT87270, Jan. 13, 2005.
Miyagawa et al., "Evaluation of the defense system in chloroplasts to photooxidative stress caused by paraquat using transgenic tobacco plants expressing catalase from *Escherichia coli*," Plant Cell Physiol., 2000, vol. 41, No. 3, pp. 311-320.
Yeo et al., "Genetic engineering of drought resistant potato plants by introduction of the trehalose-6-phosphate synthase (TPS1) gene from *Saccharomyces cerevisiae*," Molecules and Cells, 2000, vol. 10, No. 3, pp. 263-268.
Romero et al., "Expression of the yeast trehalose-6-phosphate synthase gene in transgenic tobacco plants: Pleiotropic phenotypes include drought tolerance," Planta, 1997, vol. 201, No. 3, pp. 293-297.
Xiuyu et al., "Expression of otsA gene in tobacco and improvement Sress tolerance," Acta Microbiologica Sinica, 2001, vol. 41, No. 4, pp. 427-431.

(Continued)

*Primary Examiner* — Cynthia Collins
(74) *Attorney, Agent, or Firm* — Connolly Bove Lodge & Hutz LLP

(57) ABSTRACT

This invention relates generally to nucleic acid sequences encoding proteins that are associated with abiotic stress responses and abiotic stress tolerance in plants. In particular, this invention relates to nucleic acid sequences encoding proteins that confer drought, heat, cold, and/or salt tolerance to plants.

9 Claims, No Drawings

OTHER PUBLICATIONS

Jang et al., "Expression of a bifunctional fusion of the *Escherichia coli* genes for trehalose-6-phosphate synthase and trehalose-6-phosphate phosphatase in transgenic rice plants increases trehalose accumulation and abiotic stress tolerance without stunting growth," Plant Physiology, 2003, vol. 131, No. 2, pp. 516-524.

Zhang et al., "Genetic transformation of tobacco with the trehalose synthase gene from *Grifola frondosa* Fr. enhances the resistance to drought and salt in tobacco," Journal of Integrative Plant Biology, 2005, vol. 47, No. 5, pp. 579-587.

Han et al., "Genetic engineering of drought-resistant tobacco plants by introducing the trehalose phosphorylase (TP) gene from *Pleurotus sajor-caju*," Plant Cell, Tissue and Organ Culture, 2005, vol. 82, No. 2, pp. 151-158.

* cited by examiner

NUCLEIC ACID SEQUENCES ENCODING PROTEINS ASSOCIATED WITH ABIOTIC STRESS RESPONSE AND PLANT CELLS AND PLANTS WITH INCREASED TOLERANCE TO ENVIRONMENTAL STRESS

RELATED APPLICATIONS

This application is a national stage application (under 35 U.S.C. 371) of PCT/EP2005/055024 filed Sep. 23, 2005, which claims the benefit of US Provisional Application 60/613,194 filed Sep. 24, 2004 and US Provisional Application 60/618,738 filed Oct. 14, 2004.

SEQUENCE LISTING SUBMISSION

The Sequence Listing associated with this application is filed in electronic format via EFS-Web and hereby incorporated by reference into the specification in its entirety. The name of the text file containing the Sequence Listing is Revised Sequence Listing 13311 00021. The size of the text file is 2,568 KB, and the text file was created on Mar. 21, 2011.

This invention relates generally to nucleic acid sequences encoding proteins that are associated with abiotic stress responses and abiotic stress tolerance in plants. In particular, this invention relates to nucleic acid sequences encoding proteins that confer drought, heat, cold, and/or salt tolerance to plants.

In particular, this invention relates to nucleic acid sequences encoding proteins that confer drought, heat, cold, and/or salt tolerance and/or resistance to plants, preferably by altering the metabolic activity leading to drought, heat, cold, and/or salt tolerance and/or resistance to plants. The invention also deals with methods of producing, screening for and breeding such plant cells or plants and method of detecting stress in plants cells or plants.

Abiotic environmental stresses such as drought stress, salinity stress, heat stress and cold stress, are major limiting factors of plant growth and productivity (Boyer. 1982. Science 218, 443-448). Crop losses and crop yield losses of major crops such as rice, maize (corn) and wheat caused by these stresses represent a significant economic and political factor and contribute to food shortages in many underdeveloped countries.

Plants are typically exposed during their life cycle to conditions of reduced environmental water content. Most plants have evolved strategies to protect themselves against these conditions of low water or desiccation (drought). However, if the severity and duration of the drought conditions are too great, the effects on plant development, growth and yield of most crop plants are profound. Continuous exposure to drought causes major alterations in the plant metabolism. These great changes in metabolism ultimately lead to cell death and consequently yield losses.

Developing stress-tolerant plants is a strategy that has the potential to solve or mediate at least some of these problems (McKersie and Leshem, 1994. Stress and Stress Coping in Cultivated Plants, Kluwer Academic Publishers). However, traditional plant breeding strategies to develop new lines of plants that exhibit resistance (tolerance) to these types of stresses are relatively slow and require specific resistant lines for crossing with the desired line. Limited germplasm resources for stress tolerance and incompatibility in crosses between distantly related plant species represent significant problems encountered in conventional breeding. Additionally, the cellular processes leading to drought, cold and salt tolerance are complex in nature and involve multiple mechanisms of cellular adaptation and numerous metabolic pathways (McKersie and Leshem, 1994. Stress and Stress Coping in Cultivated Plants, Kluwer Academic Publishers). This multi-component nature of stress tolerance has not only made breeding for tolerance largely unsuccessful, but has also limited the ability to genetically engineer stress tolerance plants using biotechnological methods.

Drought, heat, cold and salt stresses have a common theme important for plant growth and that is water availability. Plants are exposed during their entire life cycle to conditions of reduced environmental water content. Most plants have evolved strategies to protect themselves against these conditions. However, if the severity and duration of the drought conditions are too great, the effects on plant development, growth and yield of most crop plants are profound. Since high salt content in some soils result in less available water for cell intake, its effect is similar to those observed under drought conditions. Additionally, under freezing temperatures, plant cells loose water as a result of ice formation that starts in the apoplast and withdraws water from the symplast (McKersie and Leshem, 1994. Stress and Stress Coping in Cultivated Plants, Kluwer Academic Publishers). Commonly, a plant's molecular response mechanisms to each of these stress conditions are similar.

The results of current research indicate that drought tolerance is a complex quantitative trait and that no real diagnostic marker is available yet. High salt concentrations or dehydration may cause damage at the cellular level during drought stress but the precise injury is not entirely clear (Bray, 1997. Trends Plant Sci. 2, 48-54). This lack of a mechanistic understanding makes it difficult to design a transgenic approach to improve drought tolerance. However, an important consequence of damage may be the production of reactive oxygen radicals that cause cellular injury, such as lipid peroxidation or protein and nucleic acid modification. Details of oxygen free radical chemistry and their reaction with cellular components such as cell membranes have been described (McKersie and Leshem, 1994. Stress and Stress Coping in Cultivated Plants, Kluwer Academic Publishers).

There is a need to identify genes expressed in stress tolerant plants that have the capacity to confer stress resistance to its host plant and to other plant species. It is a object of this invention to identify new methods to detect or confer stress tolerance and/or resistance in plants or plant cells.

It is the object of this invention to identify new, unique genes capable of conferring stress tolerance to plants upon expression or over-expression.

It is further object of this invention to identify, produce and breed new, unique stress tolerant and/or resistant plant cells or plants and methods of inducing and detecting stress tolerance and/or resistance in plants or plant cells. It is a further object to identify new methods to detect stress tolerance and/or resistance in plants or plant cells.

This invention fulfills in part the need to identify new, unique genes capable of conferring stress tolerance to plants upon expression or over-expression of endogenous and/or exogenous genes.

The present invention provides genes from useful plants. These genes are coding for stress related proteins (SRP) capable of conferring increased tolerance to environmental stress as compared to a wild type variety of the plant cell or plants upon over-expression.

The present invention also provides methods of modifying stress tolerance of a plant comprising, modifying the expression of a SRP (stress related protein) nucleic acid in the plant, wherein the SRP is as described below. The invention provides that this method can be performed such that the stress tolerance is either increased or decreased. Preferably, stress tolerance is increased in a plant via increasing expression of a SRP nucleic acid.

Increased expression of the endogenous gene coding for SRP can be achieved, for example, by increasing the strength of the promoter used to drive transcription of the gene and/or increasing the number of copies of the gene and its regulatory elements. Strong gene expression and multiple copies of the gene lead to increased levels of mRNA and target protein. Current methods for over-expressing proteins involve cloning the gene of interest and placing it, in a construct, next to a suitable promoter/enhancer, polyadenylation signal, and splice site, and introducing the construct into an appropriate host cell.

The invention is also directed to methods for over-expressing an endogenous gene in a cell, comprising introducing a vector containing a transcriptional regulatory sequence and one or more amplifiable markers into the cell, allowing the vector to integrate into the genome of the cell by non-homologous recombination, and allowing over-expression of the endogenous gene in the cell.

The invention is also directed to methods for over-expressing an exogenous gene in a cell, comprising introducing a vector containing a transcriptional regulatory sequence and one or more amplifiable markers into the cell, allowing the vector to integrate into the genome of the cell by non-homologous recombination, and allowing over-expression of the exogenous gene in the cell. In a preferred embodiment the expression or overexpression of a SRP nucleic acid from *Zea mays* confers increased tolerance and/or resistance to environmental stress as compared to a corresponding non-transformed wild type plant cell in a *Glycine max* cell/plant and vice versa, or a SRP nucleic acid from *Zea mays* confers increased tolerance and/or resistance to environmental stress as compared to a corresponding non-transformed wild type plant cell in a *Glycine max, Brassica napus* or *Oryza sativa* cell/plant and vice versa, or a SRP nucleic acid from *Glycine max* confers increased tolerance and/or resistance to environmental stress as compared to a corresponding non-transformed wild type plant cell in a *Zea mays, Brassica napus* or *Oryza sativa* cell/plant and vice versa, or a SRP nucleic acid from *Brassica napus* confers increased tolerance and/or resistance to environmental stress as compared to a corresponding non-transformed wild type plant cell in a *Glycine max, Zea mays* or *Oryza sativa* cell/plant and vice versa, or a SRP nucleic acid from *Oryza sativa* confers increased tolerance and/or resistance to environmental stress as compared to a corresponding non-transformed wild type plant cell in a *Glycine max, Brassica napus* or *Zea mays* cell/plant and vice versa.

The present invention provides a transgenic plant cell, wherein expression of said nucleic acid sequence in the plant cell results in increased tolerance and/or resistance to environmental stress as compared to a corresponding non-transformed wild type plant cell.

The present invention provides a transgenic plant cell transformed by Stress-Related Protein (SRP) coding nucleic acid selected from the group consisting of:

a) nucleic acid molecule encoding one of the polypeptides according to SEQ ID NO: 2, 6, 10, 14, 18, 22, 26, 30, 34, 38, 42, 46, 50, 54, 58, 62, 66, 70, 74, 78, 82, 86, 90, 94, 98, 102, 106, 110, 114, 118, 122, 126, 130, 134, 138, 142, 146, 150, 154, 158, 162, 166, 170, 174, 178, 182, 186, 190, 194, 198, 202, 206, 210, 214 and/or 218, and/or 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 788, 790, 792, 794, 796, 798, 800, 802, 804, 806, 808, 810, 812, 814, 816, 818, 820, 822, 824, 826, 828, 830, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972 and/or 974 or a fragment thereof, which confers an increased tolerance and/or resistance to environmental stress in an organism or a part thereof;

b) nucleic acid molecule comprising one of the nucleic acid molecule according to SEQ ID NO: 1, 5, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, 141, 145, 149, 153, 157, 161, 165, 169, 173, 177, 181, 185, 189, 193, 197, 201, 205, 209, 213 and/or 217 and/or 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 896, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971 and/or 973;

c) nucleic acid molecule whose sequence can be deduced from a polypeptide sequence encoded by a nucleic acid molecule of (a) or (b) as a result of the degeneracy of the genetic code and conferring an increased tolerance and/or resistance to environmental stress as compared to a corresponding non-transformed wild type plant in an organism or a part thereof;

d) nucleic acid molecule which encodes a polypeptide which has at least 50% identity with the amino acid sequence of the polypeptide encoded by the nucleic acid molecule of (a) to (c) and conferring an increased tolerance and/or resistance to environmental stress in an organism or a part thereof;

e) nucleic acid molecule which hybridizes with a nucleic acid molecule of (a) to (c) under stringent hybridisation conditions and conferring an increased tolerance and/or resistance to environmental stress in an organism or a part thereof;

f) nucleic acid molecule which encompasses a nucleic acid molecule which is obtained by amplifying nucleic acid molecules from a cDNA library or a genomic library using the primers as shown in table 2 and conferring an increased tolerance and/or resistance to environmental stress as compared to a corresponding non-transformed wild type plant in an organism or a part thereof;

g) nucleic acid molecule encoding a polypeptide which is isolated with the aid of monoclonal antibodies against a polypeptide encoded by one of the nucleic acid molecules of (a) to (f) and conferring an increased tolerance and/or resistance to environmental stress as compared to a corresponding non-transformed wild type plant in an organism or a part thereof; and h) nucleic acid molecule which is obtainable by screening a suitable nucleic acid library under stringent hybridization conditions with a probe comprising one of the sequences of the nucleic acid molecule of (a) to (g) or with a fragment thereof having at least 15 nt, preferably 20 nt, 30 nt, 50 nt, 100 nt, 200 nt or 500 nt of the nucleic acid molecule characterized in (a) to (k) and conferring an increased tolerance and/or resistance to environmental stress as compared to a corresponding non-transformed wild type plant in an organism or a part thereof, or comprising a sequence which is complementary thereto.

For the purpose of the present invention the SEQ ID NOs and the expression:

SEQ ID NO 1, 5, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, 141, 145, 149, 153, 157, 161, 165, 169, 173, 177, 181, 185, 189, 193, 197, 201, 205, 209, 213 and/or 217; and/of 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971 and/or 973 are summarized and named as "SEQ ID NO: (4n+1) for n=0 to 54 and (2n+1) for n=110 to 487".

This means, throughout the instant specification the term:

"SEQ ID NO 1, 5, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, 141, 145, 149, 153, 157, 161, 165, 169, 173, 177, 181, 185, 189, 193, 197, 201, 205, 209, 213 and/or 217; and/of 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499; 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971 and/or 973" and the term "SEQ ID NO: (4n+1) for n=0 to 54 and (2n+1) for n=110 to 487" are identical and interchangeably in the present context.

For the purpose of the present invention, the SEQ ID NOs and the expression:

SEQ ID NO 2, 6, 10, 14, 18, 22, 26, 30, 34, 38, 42, 46, 50, 54, 58, 62, 66, 70, 74, 78, 82, 86, 90, 94, 98, 102, 106, 110, 114, 118, 122, 126, 130, 134, 138, 142, 146, 150, 154, 158, 162, 166, 170, 174, 178, 182, 186, 190, 194, 198, 202, 206, 210, 214 and/or 218 and/or 772, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 788, 790, 792, 794, 796, 798, 800, 802, 804, 806, 808, 810, 812, 814, 816, 818, 820, 822, 824, 826, 828, 830, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972 and/or 974 are summarized and named as "SEQ ID NO: (4n+2) for n=0 to 54 and (2n+2) for n=110 to 487".

This means, throughout the instant specification the term:

"SEQ ID NO 2, 6, 10, 14, 18, 22, 26, 30, 34, 38, 42, 46, 50, 54, 58, 62, 66, 70, 74, 78, 82, 86, 90, 94, 98, 102, 106, 110, 114, 118, 122, 126, 130, 134, 138, 142, 146, 150, 154, 158, 162, 166, 170, 174, 178, 182, 186, 190, 194, 198, 202, 206, 210, 214 and/or 218 and/or 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 788, 790, 792, 794, 796, 798, 800, 802, 804, 806, 808, 810, 812, 814, 816, 818, 820, 822, 824, 826, 828, 830, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972 and/or 974"

and the term "SEQ ID NO: (4n+2) for n=0 to 54 and (2n+2) for n=110 to 487" are identical and interchangeably in the present context.

The invention provides that the environmental stress can be salinity, drought, temperature, metal, chemical, pathogenic and oxidative stresses, or combinations thereof.

In the transgenic plant cell of the invention, the expression of said nucleic acid results in increased tolerance to an environmental stress as compared to a corresponding non-transformed wild type plant cell. Herein, the environmental stress is selected from the group consisting of salinity, drought, temperature, metal, chemical, pathogenic and oxidative stresses, or combinations thereof.

The terms "increased", "rised", "extended", "enhanced", "improved" or "amplified" relate to a corresponding change of a property in an organism, a part of an organism such as a tissue, seed, root, leave, flower etc. or in a cell and are interchangeable. Preferably, the overall activity in the volume is increased or enhanced in cases if the increase or enhancement is related to the increase or enhancement of an activity of a gene product, independent whether the amount of gene product or the specific activity of the gene product or both is increased or enhanced or whether the amount, stability or translation efficacy of the nucleic acid sequence or gene encoding for the gene product is increased or enhanced. The terms "reduction", "decrease" or "deletion" relate to a corresponding change of a property in an organism, a part of an organism such as a tissue, seed, root, leave, flower etc. or in a cell. Preferably, the overall activity in the volume is reduced, decreased or deleted in cases if the reduction, decrease or deletion is related to the reduction, decrease or deletion of an activity of a gene product, independent whether the amount of gene product or the specific activity of the gene product or both is reduced, decreased or deleted or whether the amount, stability or translation efficacy of the nucleic acid sequence or gene encoding for the gene product is reduced, decreased or deleted.

The terms "increase" or "decrease" relate to a corresponding change of a property in an organism or in a part of an organism, such as a tissue, seed, root, leave, flower etc. or in a cell. Preferably, the overall activity in the volume is increased in cases the increase relates to the increase of an activity of a gene product, independent whether the amount of gene product or the specific activity of the gene product or both is increased or generated or whether the amount, stability or translation efficacy of the nucleic acid sequence or gene encoding for the gene product is increased.

Under "change of a property" it is understood that the activity, expression level or amount of a gene product or the metabolite content is changed in a specific volume relative to a corresponding volume of a control, reference or wild type, including the de novo creation of the activity or expression.

The terms "increase" or "decrease" include the change of said property in only parts of the subject of the present invention, for example, the modification can be found in compartment of a cell, like a organelle, or in a part of a plant, like tissue, seed, root, leave, flower etc. but is not detectable if the overall subject, i.e. complete cell or plant, is tested. Preferably, the increase or decrease is found cellular, thus the term "increase of an acitivity" or "increase of a metabolite content" relates to the cellular increase compared to the wild type cell.

Accordingly, the term "increase" or "decrease" means that the specific activity of an enzyme as well as the amount of a compound or metabolite, e.g. of a polypeptide, a nucleic acid molecule or of the fine chemical of the invention or an encoding mRNA or DNA, can be increased or decreased in a volume.

The terms "wild type", "control" or "reference" are exchangeable and can be a cell or a part of organisms such as an organelle or a tissue, or an organism, in particular a microorganism or a plant, which was not modified or treated according to the herein described process according to the invention. Accordingly, the cell or a part of organisms such as an organelle or a tissue, or an organism, in particular a microorganism or a plant used as wild type, control or reference corresponds to the cell, organism or part thereof as much as possible and is in any other property but in the result of the process of the invention as identical to the subject matter of the invention as possible. Thus, the wild type, control or reference is treated identically or as identical as possible, saying that only conditions or properties might be different which do not influence the quality of the tested property.

Preferably, any comparison is carried out under analogous conditions. The term "analogous conditions" means that all conditions such as, for example, culture or growing conditions, assay conditions (such as buffer composition, temperature, substrates, pathogen strain, concentrations and the like) are kept identical between the experiments to be compared.

The "reference", "control", or "wild type" is preferably a subject, e.g. an organelle, a cell, a tissue, an organism, in particular a plant or a microorganism, which was not modified or treated according to the herein described process of the invention and is in any other property as similar to the subject matter of the invention as possible. The reference, control or wild type is in its genome, transcriptome, proteome or metabolome as similar as possible to the subject of the present invention. Preferably, the term "reference-" "control-" or "wild type-"-organelle, -cell, -tissue or -organism, in particular plant or microorganism, relates to an organelle, cell, tissue or organism, in particular plant or microorganism, which is nearly genetically identical to the organelle, cell, tissue or organism, in particular microorganism or plant, of the present invention or a part thereof preferably 95%, more preferred are 98%, even more preferred are 99.00%, in particular 99.10%, 99.30%, 99.50%, 99.70%, 99.90%, 99.99%, 99.999% or more. Most preferable the "reference", "control", or "wild type" is a subject, e.g. an organelle, a cell, a tissue, an organism, which is genetically identical to the organism, cell or organelle used according to the process of the invention except that the responsible or activity conferring nucleic acid molecules or the gene product encoded by them are amended, manipulated, exchanged or introduced according to the inventive process.

Preferably, the reference, control or wild type differs form the subject of the present invention only in the cellular activity of the polypeptide of the invention, e.g. as result of an increase in the level of the nucleic acid molecule of the present invention or an increase of the specific activity of the polypeptide of the invention, e.g. by or in the expression level or activity of an protein having the activity of an Stress-Related Protein (SRP) or its homologs, its biochemical or genetical causes and the increased tolerance and/or resistance to environmental stress as compared to a corresponding non-transformed wild type plant.

In case, a control, reference or wild type differing from the subject of the present invention only by not being subject of the process of the invention can not be provided, a control, reference or wild type can be an organism in which the cause for the modulation of an activity conferring the increased tolerance and/or resistance to environmental stress as compared to a corresponding non-transformed wild type plant or expression of the nucleic acid molecule of the invention as described herein has been switched back or off, e.g. by knocking out the expression of responsible gene product, e.g. by antisense inhibition, by inactivation of an activator or agonist, by activation of an inhibitor or antagonist, by inhibition through adding inhibitory antibodies, by adding active compounds as e.g. hormones, by introducing negative dominant mutants, etc. A gene production can for example be knocked out by introducing inactivating point mutations, which lead to an enzymatic activity inhibition or a destabilization or an inhibition of the ability to bind to cofactors etc.

Accordingly, preferred reference subject is the starting subject of the present process of the invention. Preferably, the reference and the subject matter of the invention are compared after standardization and normalization, e.g. to the amount of total RNA, DNA, or protein or activity or expression of reference genes, like housekeeping genes, such as ubiquitin, actin or ribosomal proteins.

A series of mechanisms exists via which a modification of the a protein, e.g. the polypeptide of the invention can directly or indirectly affect the yield, production and/or production efficiency of the amino acid.

For example, the molecule number or the specific activity of the polypeptide or the nucleic acid molecule may be increased. Larger amounts of the fine chemical can be produced if the polypeptide or the nucleic acid of the invention is expressed de novo in an organism lacking the activity of said protein. However, it is also possible to increase the expression of the gene which is naturally present in the organisms, for example by modifying the regulation of the gene, or by increasing the stability of the corresponding mRNA or of the corresponding gene product encoded by the nucleic acid molecule of the invention, or by introducing homologous genes from other organisms which are differently regulated, eg. not feedback sensitive.

This also applies analogously to the combined increased expression of the nucleic acid molecule of the present invention or its gene product with that of further enzymes of the amino acid biosynthesis pathways, e.g. which are useful for the synthesis of the fine chemicals.

The increase, decrease or modulation according to this invention can be constitutive, e.g. due to a stable permanent transgenic expression or to a stable mutation in the corresponding endogenous gene encoding the nucleic add molecule of the invention or to a modulation of the expression or of the behaviour of a gene conferring the expression of the polypeptide of the invention, or transient, e.g. due to an transient transformation or temporary addition of a modulator such as a agonist or antagonist or inducible, e.g. after transformation with a inducible construct carrying the nucleic acid molecule of the invention under control of a induceable promoter and adding the inducer, e.g. tetracycline or as described herein below.

The increase in activity of the polypeptide amounts in a cell, a tissue, a organelle, an organ or an organism or a part thereof preferably to at least 5%, preferably to at least 20% or at to least 50%, especially preferably to at least 70%, 80%, 90% or more, very especially preferably are to at least 200%, most preferably are to at least 500% or more in comparison to the control, reference or wild type.

The specific activity of a polypeptide encoded by a nucleic acid molecule of the present invention or of the polypeptide of the present invention can be tested as described in the examples. In particular, the expression of a protein in question in a cell, e.g. a plant cell or a microorganism and the detection of an increase the fine chemical level in comparison to a control is an easy test and can be performed as described in the state of the art.

The term "increase" includes, that a compound or an activity is introduced into a cell de novo or that the compound or the activity has not been detectable before, in other words it is "generated".

Accordingly, in the following, the term "increasing" also comprises the term "generating" or "stimulating". The increased activity manifests itself in an increase of the fine chemical.

The transformed plant cells are compared to the corresponding non-transformed wild type of the same genus and species under otherwise identical conditions (such as, for example, culture conditions, age of the plants and the like). In this context, a increase in tolerance and/or resistance to environmental stress of at least 10%, advantageously of at least 20%, preferably at least 30%, especially preferably of at least 40%, 50% or 60%, very especially preferably of at least 70%, 80%, 90%, 95% or even 100% or more, in comparison with the non-transformed organism is advantageous.

The present invention provides a transgenic plant cell, wherein expression of said nucleic acid sequence in the plant cell results in increased tolerance and/or resistance to environmental stress as compared to a corresponding non-transformed wild type plant cell. One preferred wild type plant cell is a non-transformed *Arabidopsis* plant cell. An example here is the *Arabidopsis* wild type C24 (Nottingham *Arabidopsis* Stock Centre, UK; NASC Stock N906).

Other preferred wild type plant cells are a non-transformed from plants selected from the group consisting of maize, wheat, rye, oat, triticale, rice, barley, soybean, peanut, cotton, rapeseed, canola, manihot, pepper, sunflower, flax, borage, safflower, linseed, primrose, rapeseed, turnip rape, tagetes, solanaceous plants, potato, tobacco, eggplant, tomato, *Vicia* species, pea, alfalfa, coffee, cacao, tea, *Salix* species, oil palm, coconut, perennial grass and forage crops.

More preferred wild type plant cells are a non transformed *Linum* plant cell, preferably Unum usitatissimum, more preferably the variety Brigitta, Golda, Gold Merchant, Helle, Juliet, Olpina, Livia, Marlin, Maedgold, Sporpion, Serenade, Linus, Taunus, Lifax or Liviola, a non-transformed Heliantus plant cell, preferably Heliantus annuus, more preferably the variety Aurasol, Capella, Flavia, Flores, Jazzy, Palulo, Pegasol, PIR64A54, Rigasol, Sariuca, Sideral, Sunny, Alenka, Candisol or Floyd, or a non-transformed *Brassica* plant cell, preferably *Brassica napus*, more preferably the variety Dorothy, Evita, Heros, Hyola, Kimbar, Lambada, Licolly, Liconira, Licosmos, Lisonne, Mistral, Passat, Serator, Siapula, Sponsor, Star, Caviar, Hybridol, Baical, Olga, Lara, Doublol, Karola, Falcon, Spirit, Olymp, Zeus, Libero, Kyota, Licord, Lion, Lirajet, Lisbeth, Magnum, Maja, Mendel, Mica, Mohican, Olpop, Ontarion, Panthar, Prinoe, Pronio, Susanna, Talani, Titan, Transfer, Wiking, Woltan, Zeniah, Artus, Contact or Smart.

The expression of said nucleic acid sequence in the plant cell may directly or indirectly influence the tolerance and/or resistance to environmental stress as compared to a corresponding non-transformed wild type plant of the transformed plant cells.

Preferably they influence the activity of the above metabolites.

Preferably increased tolerance and/or resistance to environmental stress as compared to a corresponding non-transformed wild type plant may be altered by transformation with one or more Stress-Related Protein (SRP) coding nucleic acid selected from the group comprising the nucleic acid according to SEQ ID NO: (4n+1) for n=0 to 54 and (2n+1) for n=110 to 487 or homologs of the afore mentioned sequences.

It is within the scope of the invention to identify the genes encoded by a nucleic acid sequence selected from the group consisting of the nucleic acid according to SEQ ID NO: (4n+1) for n=0 to 54 and (2n+1) for n=110 to 487 and/or homologs thereof in target plants, especially crop plants, and then express the corresponding gene to achieve the increased tolerance and/or resistance to environmental stress. Consequently the invention is not limited to a specific plant.

A protein having an activity conferring an increased tolerance and/or resistance to environmental stress as compared to a corresponding non-transformed wild type plant preferably has the structure of the polypeptide described herein, of the polypeptide according SEQ ID NO: (4n+2) for n=0 to 54 and (2n+2) for n=110 to 487 or the functional homologues thereof as described herein, or is encoded by the nucleic acid molecule characterized herein or the nucleic acid molecule according to the invention, for example by the nucleic acid molecule according to SEQ ID NO: (4n+1) for n=0 to 54 and (2n+1) for n=110 to 487 or its herein described functional homologues and has the herein mentioned activity.

It is also within the scope of the invention to screen plant cells or plants for increased tolerance and/or resistance to environmental stress by screening the plant cells under stress conditions for increased tolerance and/or resistance to environmental stress as compared to non-stress conditions. This allows selection of plants with increased tolerance and/or resistance to environmental stress without the identification of genes or visual symptoms.

With the invention it is further possible to breed plant cells or plants towards increased tolerance and/or resistance to environmental stress by screening the plant cells under stress conditions for increased tolerance and/or resistance to environmental stress as compared to non-stress conditions and selecting those with increased tolerance and/or resistance to environmental stress. The screening for increased tolerance and/or resistance to environmental stress is faster and easier than e.g. screening for genes.

Screening is well known to those skilled in the art and generally refers to the search for a particular attribute or trait. In the invention this trait in a plant or plant cell is the general appearance, healthy, visual symptoms of injury, such as wilting and leaf browning, or the concentration of a metabolite. The methods and devices for screening are familiar to those skilled in the art and include GC (gas chromatography), LC (liquid chromatography), HPLC (high performance (pressure) liquid chromatography), MS (mass spectrometry), NMR (nuclear magnetic resonance) spectroscopy, IR (infra red) spectroscopy, photometric methods etc and combinations of these methods.

Breeding is also customary knowledge for those skilled in the art. It is understood as the directed and stable incorporation of a particular attribute or trait into a plant or plant cell.

The various breeding steps are characterized by well-defined human intervention such as selecting the lines to be crossed, directing pollination of the parental lines, or selecting appropriate progeny plants. Different breeding measures can be taken, depending on the desired properties. All the techniques are well known by a person skilled in the art and include for example, but are not limited to hybridization, inbreeding, backcross breeding, multiline breeding, variety blend, interspecific hybridization, aneuploid techniques, etc. Hybridization techniques also can include the sterilization of plants to yield male or female sterile plants by mechanical, chemical, or biochemical means. Cross pollination of a male sterile plant with pollen of a different line assures that the genome of the male sterile but female fertile plant will uniformly obtain properties of both of the parental lines. The transgenic seeds and plants according to the invention can therefor be used for the breeding of improved plant lines, which can increase the effectiveness of conventional methods such as herbicide or pesticide treatment or which allow one to dispense with said methods due to their modified genetic properties. Alternatively new crops with improved stress tolerance, preferably drought and temperature, can be obtained, which, due to their optimized genetic "equipment", yield harvested product of better quality than products that were not able to tolerate comparable adverse developmental conditions.

The invention provides that the environmental stress can be salinity, drought, temperature, metal, chemical, pathogenic and oxidative stresses, or combinations thereof, preferably drought and/or temperature.

The object of the invention is a transgenic plant cell, wherein the SRP (=stress related protein) is selected preferably from yeast, preferably *Saccharomyces cerevisiae*, or *E. coli* or a plant.

The object of the invention is a transgenic plant cell, wherein the SRP (=stress related protein) is selected preferably from a plant, preferably *Brassica napus, Glycine max, Zea mays* or *Oryza sativa* or yeast, preferably *Saccharomyces cerevisiae*, or *E. coli*, more preferably from *Brassica napus, Glycine max, Zea mays* or *Oryza sativa*.

Object of the invention is also a transgenic plant cell, wherein the SRP coding nucleic acid is at least about 50% homologous to one of the nucleic acid according to SEQ ID NO: (4n+1) for n=0 to 54 and (2n+1) for n=110 to 487

In the transgenic plant cell of the invention, the expression of said nucleic acid results in increased tolerance to an environmental stress as compared to a corresponding non-transformed wild type plant cell. Herein, the environmental stress is selected from the group consisting of salinity, drought, temperature, metal, chemical, pathogenic and oxidative stresses, or combinations thereof, preferably drought and/or temperature.

The term "expression" refers to the transcription and/or translation of a codogenic gene segment or gene. As a rule, the resulting product is an mRNA or a protein. However, expression products can also include functional RNAs such as, for example, antisense nucleic acids, tRNAs, snRNAs, rRNAs, RNAi, siRNA, ribozymes etc. Expression may be systemic, local or temporal, for example limited to certain cell types, tissue, sorgans or time periods.

Unless otherwise specified, the terms "polynucleotides", "nucleic acid" and "nucleic acid molecule" are interchangeably in the present context. Unless otherwise specified, the terms "peptide", "polypeptide" and "protein" are interchangeably in the present context. The term "sequence" may relate to polynucleotides, nucleic acids, nucleic acid molecules, peptides, polypeptides and proteins, depending on the context in which the term "sequence" is used. The terms "gene(s)", "polynucleotide", "nucleic acid sequence", "nucleotide sequence", or "nucleic acid molecule(s)" as used herein refers to a polymeric form of nucleotides of any length, either ribonucleotides or deoxyribonucleotides. The terms refer only to the primary structure of the molecule.

Thus, the terms "gene(s)", "polynucleotide", "nucleic acid sequence", "nucleotide sequence", or "nucleic acid molecule(s)" as used herein include double- and single-stranded DNA and RNA. They also include known types of modifications, for example, methylation, "caps", substitutions of one or more of the naturally occurring nucleotides with an analog. Preferably, the DNA or RNA sequence of the invention comprises a coding sequence encoding the herein defined polypeptide.

A "coding sequence" is a nucleotide sequence, which is transcribed into mRNA and/or translated into a polypeptide when placed under the control of appropriate regulatory sequences. The boundaries of the coding sequence are determined by a translation start codon at the 5'-terminus and a translation stop codon at the 3'-terminus. A coding sequence can include, but is not limited to mRNA, cDNA, recombinant nucleotide sequences or genomic DNA, while introns may be present as well under certain circumstances.

For the purposes of the invention, as a rule the plural is intended to encompass the singular and vice versa.

Further, the transgenic plant cell is derived from a monocotyledonous plant. Alternative, the transgenic plant cell is derived from a dicotyledonous plant. Preferably, the transgenic plant cell is selected from the group consisting of maize, wheat, rye, oat, triticale, rice, barley, soybean, peanut, cotton, rapeseed, canola, manihot, pepper, sunflower, flax, borage, sunflower, linseed, primrose, rapeseed, turnip rape, tagetes, solanaceous plants, potato, tabacco, eggplant, tomato, *Vicia* species, pea, alfalfa, coffee, cacao, tea, *Salix* species, oil palm, coconut, perennial grass, forage crops and *Arabidopsis thaliana*. Moreover, the transgenic plant cell of the present invention can be derived from a gymnosperm plant. Preferably, the plant is selected from the group of spruce, pine and fir.

The invention further provides a seed produced by a transgenic plant transformed by a SRP coding nucleic acid, wherein the plant is true breeding for increased tolerance to environmental stress as compared to a wild type plant cell. The transgenic plant might be a monocot, a dicot or a gymnosperm plant. The invention further provides a seed produced by a transgenic plant expressing an SRP wherein the plant is true breeding for increased tolerance to environmental stress as compared to a wild type plant cell. The invention pertains to a seed produced by a transgenic plant, wherein the seed is genetically homozygous for a transgene conferring an increased tolerance to environmental stress as compared to a wild type plant.

The invention further provides an agricultural product produced by any of the below-described transgenic plants, plant parts such as leafs, petal, anther, roots, tubers, stems, buds, flowers or seeds. The invention further provides a isolated recombinant expression vector comprising a SRP encoding nucleic acid.

The invention further provides a method of producing a transgenic plant with a SRP coding nucleic acid, wherein expression of the nucleic acid in the plant results in increased tolerance and/or resistance to an environmental stress as compared to a corresponding non-transformed wild type plant cell, comprising a) transforming a plant cell with an expression vector including a SRP encoding nucleic acid selected from the group comprising the nucleic acid according to SEQ ID NO: 1, 5, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, 141, 145, 149, 153, 157, 161, 165, 169, 173, 177, 181, 185, 189, 193, 197, 201, 205, 209, 213 and/or 217 and/or and/or 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971 and/or 973 homologs or parts thereof and b) generating from the plant cell a transgenic plant with an increased tolerance to environmental stress as compared to a corresponding non-transformed wild type plant.

With regard to invention described here, "transformed or transgene" means all those plants or parts thereof which have been brought about by genetic manipulation methods and in which either a) one or more genes, preferably encoded by one or more nucleic acid sequences as depicted in SEQ ID NO: 1, 5, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, 141, 145, 149, 153, 157, 161, 165, 169, 173, 177, 181, 185, 189, 193, 197, 201, 205, 209, 213 and/or 217 and/or 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971 and/or 973 and/or a homolog thereof, or b) a genetic regulatory element, for example a promoter, which is functionally linked e.g. to the nucleic acid sequence as depicted in SEQ ID NO: 1, 5, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, 141, 145, 149, 153, 157, 161, 165, 169, 173, 177, 181, 185, 189, 193, 197, 201, 205, 209, 213 and/or 217 and/or 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819; 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971 and/or 973 and/or a homolog thereof, or (a) and (b)

is/are not present in its/their natural genetic environment or has/have been modified by means of genetic manipulation methods, it being possible for the modification to be, by way of example, a substitution, addition, deletion, inversion or insertion of one or more nucleotide radicals.

"Natural genetic environment" means the natural chromosomal locus in the organism of origin or the presence in a genomic library. In the case of a genomic library, the natural, genetic environment of the nucleic acid sequence is preferably at least partially still preserved. The environment flanks the nucleic acid sequence at least on one side and has a sequence length of at least 50 bp, preferably at least 500 bp, particularly preferably at least 1000 bp, very particularly preferably at least 5000 bp. In said method for producing a transgenic plant comprising an SRP, the SRP coding nucleic acid is selected from the group comprising the nucleic acid according to SEQ ID NO: (4n+1) for n=0 to 54 and (2n+1) for n=110 to 487 and/or homologs of the afore mentioned sequences. Further, the SRP coding nucleic acid used in the said method is at least about 50% homologous to one of the nucleic acid according to SEQ ID NO: (4n+1) for n=0 to 54 and (2n+1) for n=110 to 487.

A plant or plant cell is considered "true breeding" for a particular trait if it is genetically homozygous for that trait to the extent that, when the true-breeding plant is self-pollinated, a significant amount of independent segregation of the trait among the progeny is not observed. In the present invention, the trait arises from the transgenic expression of one or more DNA sequences introduced into a plant cell or plant.

The present invention also provides methods of modifying stress tolerance of a plant comprising, modifying the level of expression of a SRP nucleic acid in the plant. The invention provides one method of producing a transgenic plant with a synthetic, novel or modified transcription factor that acts by increasing the transcription of a SRP gene. Theoretically it is also possible to obtain a decrease in expression of the gene.

A method of detecting environmental stress in plant cells or plants comprising screening the plant cells for increased tolerance and/or resistance to environmental stress as compared to non-stress conditions is also in the scope of the invention.

Further a method of screening plant cells or plants for increased tolerance and/or resistance to environmental stress comprising screening the plant cells under stress conditions as compared to non-stress conditions is encompassed in the invention.

The present invention also encloses a method of breeding plant cells or plants towards increased tolerance and/or resistance to environmental stress comprising screening the plant cells under stress conditions for increased tolerance and/or resistance to environmental stress as compared to non-stress conditions and selecting those with increased tolerance and/or resistance to environmental stress.

The present invention also encompasses the use of increased tolerance and/or resistance to environmental stress and/or a SRP encoding nucleic acid selected from the group comprising the nucleic acid according to SEQ ID NO: (4n+1) for n=0 to 54 and (2n+1) for n=110 to 487 and/or homologs of the afore mentioned sequences or parts thereof as markers for selection of plants or plant cells with increased tolerance to environmental stress.

The present invention further encompasses the use of increased tolerance and/or resistance to environmental stress and/or a SRP encoding nucleic acid selected from the group comprising the nucleic acid according to SEQ ID NO: (4n+1) for n=0 to 54 and (2n+1) for n=110 to 487 and/or homologs of the afore mentioned sequences or parts thereof as markers for detection of stress in plants or plant cells.

The present invention also provides methods of modifying stress tolerance of a crop plant comprising utilizing a SRP coding nucleic acid sequence to identify individual plants in populations segregating for either increased or decreased environmental stress tolerance (DNA marker).

In the said method of modifying stress tolerance of a plant the SRP encoding nucleic acid may be selected from the group comprising the nucleic acid according to SEQ ID NO: (4n+1) for n=0 to 54 and (2n+1) for n=110 to 487 and/or homologs of the afore mentioned sequences. Further the SRP coding nucleic acid used therein may at least about 50% homologous to one of the nucleic acid according to SEQ ID NO: $(4n_{+}1)$ for n=0 to 54 and (2n+1) for n=110 to 487. Also an expression vector as described in the present invention might be used in the said method.

In a variant method of said method of modifying stress tolerance, the plant is transformed with an inducible promoter that directs expression of the SRP. For example, the promoter is tissue specific. In a variant method, the used promoter is developmentally regulated.

In a further embodiment, the method of modifying stress tolerance comprises one or more of the following steps:

a) stabilizing a protein conferring the increased expression of a protein encoded by the nucleic acid molecule of the invention or of the polypeptide of the invention having the herein-mentioned activity of increasing tolerance and/or resistance to environmental stress as compared to a corresponding non-transformed wild type plant cell;

b) stabilizing a mRNA conferring the increased expression of a protein encoded by the nucleic acid molecule of the invention or its homologs or of a mRNA encoding the polypeptide of the present invention having the herein-mentioned activity of increasing tolerance and/or resistance to environmental stress as compared to a corresponding non-transformed wild type plant cell;

c) increasing the specific activity of a protein conferring the increased expression of a protein encoded by the nucleic acid molecule of the invention or of the polypeptide of the present invention or decreasing the inhibitory regulation of the polypeptide of the invention;

d) generating or increasing the expression of an endogenous or artificial transcription factor mediating the expression of a protein conferring the increased expression of a protein encoded by the nucleic acid molecule of the invention or of the polypeptide of the invention having the herein-mentioned activity of increasing tolerance and/or resistance to environmental stress as compared to a corresponding non-transformed wild type plant cell;

e) stimulating activity of a protein conferring the increased expression of a protein encoded by the nucleic acid molecule of the present invention or a polypeptide of the present invention having the herein-mentioned activity of increasing the tolerance and/or resistance to environmental stress by adding one or more exogenous inducing factors to the organisms or parts thereof;

f) expressing a transgenic gene encoding a protein conferring the increased expression of a polypeptide encoded by the nucleic acid molecule of the present invention or a polypeptide of the present invention, having the herein-mentioned activity of increasing tolerance and/or resistance to environmental stress as compared to a corresponding non-transformed wild type plant cell; and/or g) increasing the copy number of a gene conferring the increased expression of a nucleic acid molecule encoding a polypeptide encoded by the nucleic acid molecule of the invention or the polypeptide of the invention having the herein-mentioned activity of increasing tolerance and/or resistance to environmental stress as compared to a corresponding non-transformed wild type plant cell;

h) increasing the expression of the endogenous gene encoding the polypeptide of the invention or its homologs by adding positive expression or removing negative expression elements, e.g. homologous recombination can be used to either introduce positive regulatory elements like for plants the 35S enhancer into the promoter or to remove repressor elements form regulatory regions. Further gene conversion methods can be used to disrupt repressor elements or to enhance to activity of positive elements-positive elements can be randomly introduced in plants by T-DNA or transposon mutagenesis and lines can be identified in which the positive elements have be integrated near to a gene of the invention, the expression of which is thereby enhanced; and/or i) modulating growth conditions of the plant in such a manner, that the expression or activity of the gene encoding the protein of the invention or the protein itself is enhanced;

j) selecting of organisms with especially high activity of the proteins of the invention from natural or from mutagenized resources and breeding them into the target organisms, eg the elite crops.

Preferably, said mRNA is the nucleic acid molecule of the present invention and/or the protein conferring the increased expression of a protein encoded by the nucleic acid molecule of the present invention or the polypeptide having the herein mentioned activity is the polypeptide of the present invention, e.g. conferring increased tolerance to environmental stress.

In general, the amount of mRNA, polynucleotide or nucleic acid molecule in a cell or a compartment of an organism correlates with the amount of encoded protein and thus with the overall activity of the encoded protein in said volume. Said correlation is not always linear, the activity in the volume is dependent on the stability of the molecules, the degradation of the molecules or the presence of activating or inhibiting co-factors. Further, product and educt inhibitions of enzymes are well known, e.g. Zinser et al. "Enzyminhibitoren/Enzyme inhibitors".

The activity of the abovementioned proteins and/or polypeptide encoded by the nucleic acid molecule of the present invention can be increased in various ways. For example, the activity in an organism or in a part thereof, like a cell, is increased via increasing the gene product number, e.g. by increasing the expression rate, like introducing a stronger promoter, or by increasing the stability of the mRNA expressed, thus increasing the translation rate, and/or increasing the stability of the gene product, thus reducing the proteins decayed. Further, the activity or turnover of enzymes can be influenced in such a way that a reduction or increase of the reaction rate or a modification (reduction or increase) of the affinity to the substrate results, is reached. A mutation in the catalytic centre of an polypeptide of the invention, e.g. as enzyme, can modulate the turn over rate of the enzyme, e.g. a knock out of an essential amino acid can lead to a reduced or completely knock out activity of the enzyme, or the deletion or mutation of regulator binding sites can reduce a negative regulation like a feedback inhibition (or a substrate inhibition, if the substrate level is also increased). The specific activity of an enzyme of the present invention can be increased such that the turn over rate is increased or the binding of a co-factor is improved. Improving the stability of the encoding mRNA or the protein can also increase the activity of a gene product. The stimulation of the activity is also under the scope of the term "increased activity".

Moreover, the regulation of the abovementioned nucleic acid sequences may be, modified so that gene expression is increased. This can be achieved advantageously by means of heterologous regulatory sequences or by modifying, for example mutating, the natural regulatory sequences which are present. The advantageous methods may also be combined with each other.

In general, an activity of a gene product in an organism or part thereof, in particular in a plant cell, a plant, or a plant tissue or a part thereof or in a microorganism can be increased by increasing the amount of the specific encoding mRNA or the corresponding protein in said organism or part thereof. "Amount of protein or mRNA" is understood as meaning the molecule number of polypeptides or mRNA molecules in an organism, a tissue, a cell or a cell compartment. "Increase" in the amount of a protein means the quantitative increase of the molecule number of said protein in an organism, a tissue, a cell or a cell compartment or part thereof—for example by one of the methods described herein below—in comparison to a wild type, control or reference.

The increase in molecule number amounts preferably to at least 1%, preferably to more than 10%, more preferably to 30% or more, especially preferably to 50%, 70% or more, very especially preferably to 100%, most preferably to 500% or more. However, a de novo expression is also regarded as subject of the present invention.

A modification, i.e. an increase or decrease, can be caused by endogenous or exogenous factors. For example, an increase in activity in an organism or a part thereof can be caused by adding a gene product or a precursor or an activator or an agonist to the media or nutrition or can be caused by introducing said subjects into a organism, transient or stable.

In one embodiment the increase or decrease in tolerance and/or resistance to environmental stress as compared to a corresponding non-transformed wild type plant cell in the plant or a part thereof, e.g. in a cell, a tissue, a organ, an organelle etc., is achieved by increasing the endogenous level of the polypeptide of the invention. Accordingly, in an embodiment of the present invention, the present invention relates to a process wherein the gene copy number of a gene encoding the polynucleotide or nucleic acid molecule of the invention is increased. Further, the endogenous level of the polypeptide of the invention can for example be increased by modifying the transcriptional or translational regulation of the polypeptide.

In one embodiment the increased tolerance and/or resistance to environmental stress in the plant or part thereof can be altered by targeted or random mutagenesis of the endogenous genes of the invention. For example homologous recombination can be used to either introduce positive regulatory elements like for plants the 35S enhancer into the promoter or to remove repressor elements form regulatory regions. In addition gene conversion like methods described by Kochevenko and Willmitzer (Plant Physiol. 2003 May; 132(1):174-84) and citations therein can be used to disrupt repressor elements or to enhance to activity of positive regulatory elements. Furthermore positive elements can be randomly introduced in (plant) genomes by T-DNA or transposon mutagenesis and lines can be screened for, in which the positive elements has be integrated near to a gene of the invention, the expression of which is thereby enhanced. The activation of plant genes by random integrations of enhancer elements has been described by Hayashi et al., 1992 (Science 258:1350-1353) or Weigel et al., 2000 (Plant Physiol. 122, 1003-1013) and others cited therein.

Reverse genetic strategies to identify insertions (which eventually carrying the activation elements) near in genes of interest have been described for various cases eg. Krysan et al., 1999 (Plant Cell 1999, 11, 2283-2290); Sessions et al., 2002 (Plant Cell 2002, 14, 2985-2994); Young et al., 2001, (Plant Physiol. 2001, 125, 513-518); Koprek et al., 2000 (Plant J. 2000, 24, 253-263); Jeon et al., 2000 (Plant J. 2000, 22, 561-570); Tissier et al., 1999 (Plant Cell 1999, 11, 1841-1852); Speulmann et al., 1999 (Plant Cell 1999, 11, 1853-1866). Briefly material from all plants of a large T-DNA or transposon mutagenized plant population is harvested and genomic DNA prepared. Then the genomic DNA is pooled following specific architectures as described for example in Krysan et al., 1999 (Plant Cell 1999, 11, 2283-2290). Pools of genomics DNAs are then screened by specific multiplex PCR reactions detecting the combination of the insertional mutagen (eg T-DNA or Transposon) and the gene of interest. Therefore PCR reactions are run on the DNA pools with specific combinations of T-DNA or transposon border primers and gene specific primers. General rules for primer design can again be taken from Krysan et al., 1999 (Plant Cell 1999, 11, 2283-2290) Rescreening of lower levels DNA pools lead to the identification of individual plants in which the gene of interest is activated by the insertional mutagen.

The enhancement of positive regulatory elements or the disruption or weaking of negative regulatory elements can also be achieved through common mutagenesis techniques: The production of chemically or radiation mutated populations is a common technique and known to the skilled worker. Methods for plants are described by Koomeef et al. 1982 and the citations therein and by Lightner and Caspar in "Methods in Molecular Biology" Vol 82. These techniques usually induce pointmutations that can be identified in any known gene using methods such as TILLING (Colbert et al. 2001).

Accordingly, the expression level can be increased if the endogenous genes encoding a polypeptide conferring an increased expression of the polypeptide of the present invention, in particular genes comprising the nucleic acid molecule of the present invention, are modified via homologous recombination, Tilling approaches or gene conversion Regulatory sequences can be operatively linked to the coding region of an endogenous protein and control its transcription and translation or the stability or decay of the encoding mRNA or the expressed protein. In order to modify and control the expression, promoter, UTRs, splicing sites, processing signals, polyadenylation sites, terminators, enhancers, repressors, post transcriptional or posttranslational modification sites can be changed, added or amended For example, the activation of plant genes by random integrations of enhancer elements has been described by Hayashi et al., 1992 (Science 258:1350-1353) or Weigel et al., 2000 (Plant Physiol. 122, 1003-1013) and others cited therein. For example, the expression level of the endogenous protein can be modulated by replacing the endogenous promoter with a stronger transgenic promoter or by replacing the endogenous 3'UTR with a 3'UTR, which provides more stability without amending the coding region. Further, the transcriptional regulation can be modulated by introduction of a artificial transcription factor as described in the examples. Alternative promoters, terminators and UTRs are described below.

The activation of an endogenous polypeptide having above-mentioned activity, e.g. conferring an increased tolerance to environmental stress can also be increased by introducing a synthetic transcription factor, which binds close to the coding region of the protein of the invention encoding gene and activates its transcription. A chimeric zinc finger protein can be construed, which comprises a specific DNA-binding domain and an activation domain as e.g. the VP16 domain of Herpes Simplex virus. The specific binding domain can bind to the regulatory region of the protein coding region. The expression of the chimeric transcription factor in a plant leads to a specific expression of the protein of the invention, see e.g. in WO01/52620, Oriz, Proc. Natl. Acad. Sci. USA, 2002, Vol. 99, 13290 or Guan, Proc. Natl. Acad. Sci. USA Vol. 99, 13296.

In one further embodiment of the method according to the invention, plants are used in which one of the abovementioned genes, or one of the above-mentioned nucleic acids, is mutated in a way that the activity of the encoded gene products is less influenced by cellular factors, or not at all, in comparison with the unmutated proteins. For example, well known regulation mechanism of enzymatic activity are substrate inhibition or feed back regulation mechanisms. Ways and techniques for the introduction of substitutions, deletions and additions of one or more bases, nucleotides or amino acids of a corresponding sequence are described herein below in the corresponding paragraphs and the references listed there, e.g. in Sambrook et al., Molecular Cloning, Cold Spring Habour, N.Y., 1989. The person skilled in the art will be able to identify regulation domains and binding sites of regulators by comparing the sequence of the nucleic acid molecule of the present invention or the expression product thereof with the state of the art by computer software means which comprise algorithms, for the identifying of binding sites and regulation domains or by introducing into a nucleic acid molecule or in a protein systematically mutations and assaying for those mutations which will lead to an increased specify activity or an increased activity per volume, in particular per cell.

It is therefore advantageously to express in a plant a nucleic acid molecule of the invention or a polypeptide of the invention derived from a evolutionary distantly related organism, as e.g. using a prokaryotic gene in a eukaryotic host, as in these cases the regulation mechanism of the host cell may not weaken the activity (cellular or specific) of the gene or its expression product The mutation is introduced in such a way that the production of the amino acids is not adversely affected.

Less influence on the regulation of a gene or its gene product is understood as meaning a reduced regulation of the enzymatic activity leading to an increased specific or cellular activity of the gene or its product. An increase of the enzymatic activity is understood as meaning an enzymatic activity, which is increased by at least 10%, advantageously at least 20, 30 or 40%, especially advantageously by at least 50, 60 or 70% in comparison with the starting organism.

The invention provides that the above methods can be performed such that the stress tolerance is increased. It is also possible to obtain a decrease in stress tolerance.

The invention is not limited to specific nucleic acids, specific polypeptides, specific cell types, specific host cells, specific conditions or specific methods etc. as such, but may vary and numerous modifications and variations therein will be apparent to those skilled in the art. It is also to be understood that the terminology used herein is for the purpose of describing specific embodiments only and is not intended to be limiting.

The present invention also relates to isolated Stress Related Proteins (SRP) which are selected from the group comprising the proteins of SEQ ID NO: 2, 6, 10, 14, 18, 22, 26, 30, 34, 38, 42, 46, 50, 54, 58, 62, 66, 70, 74, 78, 82, 86, 90, 94, 98, 102, 106, 110, 114, 118, 122, 126, 130, 134, 138, 142, 146, 150, 154, 158, 162, 166, 170, 174, 178, 182, 186, 190, 194, 198, 202, 206, 210, 214 and/or 218 and/or 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402, 404, 406, 408, 410, 412, 414, 416, 418, 420, 422, 424, 426, 428, 430, 432, 434, 436, 438, 440, 442, 444, 446, 448, 450, 452, 454, 456, 458, 460, 462, 464, 466, 468, 470, 472, 474, 476, 478, 480, 482, 484, 486, 488, 490, 492, 494, 496, 498, 500, 502, 504, 506, 508, 510, 512, 514, 516, 518, 520, 522, 524, 526, 528, 530, 532, 534, 536, 538, 540, 542, 544, 546, 548, 550, 552, 554, 556, 558, 560, 562, 564, 566, 568, 570, 572, 574, 576, 578, 580, 582, 584, 586, 588, 590, 592, 594, 596, 598, 600, 602, 604, 606, 608, 610, 612, 614, 616, 618, 620, 622, 624, 626, 628, 630, 632, 634, 636, 638, 640, 642, 644, 646, 648, 650, 652, 654, 656, 658, 660, 662, 664, 666, 668, 670, 672, 674, 676, 678, 680, 682, 684, 686, 688, 690, 692, 694, 696, 698, 700, 702, 704, 706, 708, 710, 712, 714, 716, 718, 720, 722, 724, 726, 728, 730, 732, 734, 736, 738, 740, 742, 744, 746, 748, 750, 752, 754, 756, 758, 760, 762, 764, 766, 768, 770, 772, 774, 776, 778, 780, 782, 784, 786, 788, 790, 792, 794, 796, 798, 800, 802, 804, 806, 808, 810, 812, 814, 816, 818, 820, 822, 824, 826, 828, 830, 832, 834, 836, 838, 840, 842, 844, 846, 848, 850, 852, 854, 856, 858, 860, 862, 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970; 972 and/or 974 and/or homologs thereof. Preferably, the isolated Stress Related Proteins (SRP) of the present invention are selected from yeast or E. coli. Further, the present invention is related to isolated Stress Related Protein (SRP) encoding nucleic acids selected from the group comprising the nucleic acid of SEQ ID NO: 1, 5, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, 141, 145, 149, 153, 157, 161, 165, 169, 173, 177, 181, 185, 189, 193, 197, 201, 205, 209, 213 and/or 217 and/or 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971 and/or 973 and/or homologs thereof, preferably from Brassica napus, Glycine max, Zea mays or Oryza sativa.

169, 173, 177, 181, 185, 189, 193, 197, 201, 205, 209, 213 and/or 217 of yeast, preferably from Saccharomyces cerevisiae or E. coli and/or 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 407, 409, 411, 413, 415, 417, 419, 421, 423, 425, 427, 429, 431, 433, 435, 437, 439, 441, 443, 445, 447, 449, 451, 453, 455, 457, 459, 461, 463, 465, 467, 469, 471, 473, 475, 477, 479, 481, 483, 485, 487, 489, 491, 493, 495, 497, 499, 501, 503, 505, 507, 509, 511, 513, 515, 517, 519, 521, 523, 525, 527, 529, 531, 533, 535, 537, 539, 541, 543, 545, 547, 549, 551, 553, 555, 557, 559, 561, 563, 565, 567, 569, 571, 573, 575, 577, 579, 581, 583, 585, 587, 589, 591, 593, 595, 597, 599, 601, 603, 605, 607, 609, 611, 613, 615, 617, 619, 621, 623, 625, 627, 629, 631, 633, 635, 637, 639, 641, 643, 645, 647, 649, 651, 653, 655, 657, 659, 661, 663, 665, 667, 669, 671, 673, 675, 677, 679, 681, 683, 685, 687, 689, 691, 693, 695, 697, 699, 701, 703, 705, 707, 709, 711, 713, 715, 717, 719, 721, 723, 725, 727, 729, 731, 733, 735, 737, 739, 741, 743, 745, 747, 749, 751, 753, 755, 757, 759, 761, 763, 765, 767, 769, 771, 773, 775, 777, 779, 781, 783, 785, 787, 789, 791, 793, 795, 797, 799, 801, 803, 805, 807, 809, 811, 813, 815, 817, 819, 821, 823, 825, 827, 829, 831, 833, 835, 837, 839, 841, 843, 845, 847, 849, 851, 853, 855, 857, 859, 861, 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971 and/or 973 and/or homologs thereof, preferably from Brassica napus, Glycine max, Zea mays or Oryza sativa.

Here, preferably, an isolated Stress Related Protein (SRP) encoding nucleic acid encodes an SRP which is selected from yeast or E. coli and/or Brassica napus, Glycine max, Zea mays or Oryza sativa.

The present invention provides stress related gene sequences selected from the group consisting of the nucleic acid of SEQ ID NO: 1, 5, 9, 13, 17, 21, 25, 29, 33, 37, 41, 45, 49, 53, 57, 61, 65, 69, 73, 77, 81, 85, 89, 93, 97, 101, 105, 109, 113, 117, 121, 125, 129, 133, 137, 141, 145, 149, 153, 157, 161, 165, Homologs of the aforementioned sequences can be isolated advantageously from yeast, fungi, viruses, algae, bacteria, such as Acetobacter (subgen. Acetobacter) aceti; Acidithiobacillus ferrooxidans; Acinetobacter sp.; Actinobacillus sp; Aeromonas salmonicida; Agrobacterium tumefaciens; Aquifex aeolicus; Arcanobacterium pyogenes; Aster yellows phytoplasma; Bacillus sp.; Bifidobacterium sp.; Borrelia burgdorferi; Brevibacterium linens; Brucella melitensis; Buchnera sp.; Butyrivibrio fibrisolvens; Campylobacter jejuni; Caulobacter crescentus; Chlamydia sp.; Chlamydophila sp.; Chlorobium limicola; Citrobacter rodentium; Clostridium sp.; Comamonas testosteroni; Corynebacterium sp.; Coxiella burnetii; Deinococcus radiodurans; Dichelobacter nodosus; Edwardsiella ictaluri; Enterobacter sp.; Erysipelothrix rhusiopathiae; Escherichia coli; Flavobacterium sp.; Francisella tularensis; Frankia sp. Cpl1; Fusobacterium nucleatum; Geobacillus stearothermophilus; Gluconobacter oxydans; Haemophilus sp.; Helicobacter pylori; Klebsiella pneumoniae; Lactobacillus sp.; Lactococcus lactis; Listeria sp.; Mannheimia haemolytica; Mesorhizobium loti; Methylophaga thalassica; Microcystis aeruginosa; Microscilla sp. PRE1; Moraxella sp. TA144; Mycobacterium sp.; Mycoplasma sp.; Neisseria sp.; Nitrosomonas sp.; Nostoc sp. PCC 7120; Novosphingobium aromaticivorans; Oenococcus oeni; Pantoea citrea; Pasteurella multocida; Pediococcus pentosaceus; Phormidium foveolarum; Phytoplasma sp.; Plectonema boryanum; Prevotella ruminicola; Propionibacterium sp.; Proteus vulgaris; Pseudomonas sp.; Ralstonia sp.; Rhizobium sp.; Rhodococcus equi; Rhodothermus marinus; Rickettsia sp.; Riemerella anatipestifer; Ruminococcus

*flavefaciens; Salmonella* sp.; *Selenomonas ruminantium; Serratia entomophila; Shigella* sp.; *Sinorhizobium meliloti; Staphylococcus* sp.; *Streptococcus* sp.; *Streptomyces* sp.; *Synechococcus* sp.; *Synechocystis* sp. PCC 6803; *Thermotoga maritima; Treponema* sp.; *Ureaplasma urealyticum; Vibrio cholerae; Vibrio parahaemolyticus; Xylella fastidiosa; Yersinia* sp.; *Zymomonas mobilis*, preferably *Salmonella* sp. or *Escherichia coli* or plants, preferably from yeasts such as from the genera *Saccharomyces, Pichia, Candida, Hansenula, Torulopsis* or *Schizosaccharomyces* or plants such as *Arabidopsis thaliana*, maize, wheat, rye, oat, triticale, rice, barley, soybean, peanut, cotton, borage, sunflower, linseed, primrose, rapeseed, canola and turnip rape, manihot, pepper, sunflower, tagetes, solanaceous plant such as potato, tobacco, eggplant and tomato, *Vicia* species, pea, alfalfa, bushy plants such as coffee, cacao, tea, *Salix* species, trees such as oil palm, coconut, perennial grass, such as ryegrass and fescue, and forage crops, such as alfalfa and clover and from spruce, pine or fir for example. More preferably homologs of aforementioned sequences can be isolated from *Saccharomyces cerevisiae, E. coli* or plants, preferably *Brassica napus, Glycine max, Zea mays* or *Oryza sativa*.

The stress related proteins of the present invention are preferably produced by recombinant DNA techniques. For example, a nucleic acid molecule encoding the protein is cloned into an expression vector, for example in to a binary vector, the expression vector is introduced into a host cell, for example the *Arabidopsis thaliana* wild type NASC N906 or any other plant cell as described in the examples see below, and the stress related protein is expressed in said host cell. Examples for binary vectors are pBIN19, pBI101, pBinAR, pGPTV, pCAMBIA, pBIB-HYG, pBecks, pGreen or pPZP (Hajukiewicz, P. et al., 1994, Plant Mol. Biol., 25: 989-994 and Hellens et al, Trends in Plant Science (2000) 5, 446-451.).

Advantageously, the nucleic acid sequences according to the invention or the gene construct together with at least one reporter gene are cloned into an expression cassette, which is introduced into the organism via a vector or directly into the genome. This reporter gene should allow easy detection via a growth, fluorescence, chemical, bioluminescence or resistance assay or via a photometric measurement. Examples of reporter genes which may be mentioned are antibiotic- or herbicide-resistance genes, hydrolase genes, fluorescence protein genes, bioluminescence genes, sugar or nucleotide metabolic genes or biosynthesis genes such as the Ura3 gene, the Ilv2 gene, the luciferase gene, the β-galactosidase gene, the gfp gene, the 2-desoxyglucose-6-phosphate phosphatase gene, the β-glucuronidase gene, β-lactamase gene, the neomycin phosphotransferase gene, the hygromycin phosphotransferase gene or the BASTA (=gluphosinate-resistance) gene. These genes permit easy measurement and quantification of the transcription activity and hence of the expression of the genes. In this way genome positions may be identified which exhibit differing productivity.

In a preferred embodiment a nucleic acid contruct, for example an expression cassette, comprises upstream, i.e. at the 5' end of the encoding sequence, a promoter and downstream, i.e. at the 3' end, a polyadenylation signal and optionally other regulatory elements which are operably linked to the intervening encoding sequence with the nucleic acid of SEQ ID NO: (4n+1) for n=0 to 54 and (2n+1) for n=110 to 487. By an operable linkage is meant the sequential arrangement of promoter, encoding sequence, terminator and optionally other regulatory elements in such a way that each of the regulatory elements can fulfill its function in the expression of the encoding sequence in due manner. The sequences preferred for operable linkage are targeting sequences for ensuring subcellular localization in plastids. However, targeting sequences for ensuring subcellular localization in the mitochondrium, in the endoplasmic reticulum (=ER), in the nucleus, in oil corpuscles or other compartments may also be employed as well as translation promoters such as the 5' lead sequence in tobacco mosaic virus (Gallie et al., Nucl. Acids Res. 15 (1987), 8693-8711).

A nucleic acid construct, for example an expression cassette may, for example, contain a constitutive promoter or a tissue-specific promoter (preferably the USP or napin promoter) the gene to be expressed and the ER retention signal. For the ER retention signal the KDEL amino acid sequence (lysine, aspartic acid, glutamic acid, leucine) or the KKX amino acid sequence (lysine-lysine-X-stop, wherein X means every other known amino acid) is preferably employed.

For expression in a prokaryotic or eukaryotic host organism, for example a microorganism such as a fungus or a plant the expression cassette is advantageously inserted into a vector such as by way of example a plasmid, a phage or other DNA which allows optimum expression of the genes in the host organism. Examples of suitable plasmids are: in *E. coli* pLG338, pACYC184, pBR series such as e.g. pBR322, pUC series such as pUC18 or pUC19, M113 mp series, pKC30, pRep4, pHS1, pHS2, pPLc236, pMBL24, pLG200, pUR290, λgt11 or pBdCl; in *Streptomyces* pIJ101, pIJ364, pIJ702 or pIJ361; in *Bacillus* pUB110, pC194 or pBD214; in *Corynebacterium* pSA77 or pAJ667; in fungi pALS1, pIL2 or pBB116; other advantageous fungal vectors are described by Romanos, M. A. et al., [(1992) "Foreign gene expression in yeast a review", Yeast 8: 423-488] and by van den Hondel, C. A. M. J. J. et al. [(1991) "Heterologous gene expression in filamentous fungi" as well as in More Gene Manipulations in Fungi [J. W. Bennet & L. L. Lasure, eds., pp. 396-428: Academic Press: San Diego] and in "Gene transfer systems and vector development for filamentous fungi" [van den Hondel, C. A. M. J. J. & Punt, P. J. (1991) in: Applied Molecular Genetics of Fungi, Peberdy, J. F. et al., eds., pp. 1-28, Cambridge University Press: Cambridge]. Examples of advantageous yeast promoters are 2 μM, pAG-1, YEp6, YEp13 or pEMBLYe23. Examples of algal or plant promoters are pLGV23, pGHlac⁺, pBIN19, pAK2004, pVKH or pDH51 (see Schmidt, R. and Willmitzer, L., 1988). The vectors identified above or derivatives of the vectors identified above are a small selection of the possible plasmids. Further plasmids are well known to those skilled in the art and may be found, for example, in the book Cloning Vectors (Eds. Pouwels P. H. et al. Elsevier, Amsterdam-New York-Oxford, 1985, ISBN 0 444 904018). Suitable plant vectors are described inter alia in "Methods in Plant Molecular Biology and Biotechnology" (CRC Press), Ch. 6/7, pp. 71-119. Advantageous vectors are known as shuttle vectors or binary vectors which replicate in *E. coli* and *Agrobacterium*.

By vectors is meant with the exception of plasmids all other vectors known to those skilled in the art such as by way of example phages, viruses such as SV40, CMV, baculovirus, adenovirus, transposons, IS elements, phasmids, phagemids, cosmids, linear or circular DNA. These vectors can be replicated autonomously in the host organism or be chromosomally replicated, chromosomal replication being preferred.

In a further embodiment of the vector the expression cassette according to the invention may also advantageously be introduced into the organisms in the form of a linear DNA and be integrated into the genome of the host organism by way of heterologous or homologous recombination. This linear DNA may be composed of a linearized plasmid or only of the expression cassette as vector or the nucleic acid sequences according to the invention.

In a further advantageous embodiment the nucleic acid sequence according to the invention can also be introduced into an organism on its own.

If in addition to the nucleic acid sequence according to the invention further genes are to be introduced into the organism, all together with a reporter gene in a single vector or each single gene with a reporter gene in a vector in each case can be introduced into the organism, whereby the different vectors can be introduced simultaneously or successively.

The vector advantageously contains at least one copy of the nucleic acid sequences according to the invention and/or the expression cassette (=gene construct) according to the invention.

The invention further provides an isolated recombinant expression vector comprising a SRP nucleic acid as described above, wherein expression of the vector in a host cell results in increased tolerance to environmental stress as compared to a wild type variety of the host cell. As used herein, the term "vector" refers to a nucleic acid molecule capable of transporting another nucleic acid to which it has been linked. One type of vector is a "plasmid," which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as "expression vectors." In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses, and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, which is operatively linked to the nucleic acid sequence to be expressed. As used herein with respect to a recombinant expression vector, "operatively linked" is intended to mean that the nucleotide sequence of interest is linked to the regulatory sequence(s) in a manner which allows for expression of the nucleotide sequence (e.g., in an in vitro transcription/translation system or in a host cell when the vector is introduced into the host cell). The term "regulatory sequence" is intended to include promoters, enhancers, and other expression control elements (e.g., polyadenylation signals). Such regulatory sequences are described, for example, in Goeddel, Gene Expression Technology: Methods in Enzymology 185, Academic Press, San Diego, Calif. (1990) and Gruber and Crosby, in: Methods in Plant Molecular Biology and Biotechnology, eds. Glick and Thompson, Chapter 7, 89-108, CRC Press: Boca Raton, Fla., including the references therein. Regulatory sequences include those that direct constitutive expression of a nucleotide sequence in many types of host cells and those that direct expression of the nucleotide sequence only in certain host cells or under certain conditions. It will be appreciated by those skilled in the art that the design of the expression vector can depend on such factors as the choice of the host cell to be transformed, the level of expression of polypeptide desired, etc. The expression vectors of the invention can be introduced into host cells to thereby produce polypeptides or peptides, including fusion polypeptides or peptides, encoded by nucleic acids as described herein (e.g., SRPs, mutant forms of SRPs, fusion polypeptides, etc.).

The recombinant expression vectors of the invention can be designed for expression of SRPs in prokaryotic or eukaryotic cells. For example, SRP genes can be expressed in bacterial cells such as *C. glutamicum*, insect cells (using baculovirus expression vectors), yeast and other fungal cells (See Romanos, M. A. et al., 1992, Foreign gene expression in yeast: a review, Yeast 8:423-488; van den Hondel, C. A. M. J. J. et al., 1991, Heterologous gene expression in filamentous fungi, in: More Gene Manipulations in Fungi, J. W. Bennet & L. L. Lasure, eds., p. 396-428: Academic Press: San Diego; and van den Hondel, C. A. M. J. J. & Punt, P. J., 1991, Gene transfer systems and vector development for filamentous fungi, in: Applied Molecular Genetics of Fungi, Peberdy, J. F. et al., eds., p. 1-28, Cambridge University Press: Cambridge), algae (Falciatore et al., 1999, Marine Biotechnology 1(3): 239-251), ciliates of the types: *Holotrichia, Peritrichia, Spirotrichia, Suctoria, Tetrahymena, Paramecium, Colpidium, Glaucoma, Platyophrya, Potomacus, Pseudocohnilembus, Euplotes, Engelmaniella*, and *Stylonychia*, especially of the genus *Stylonychia lemnae* with vectors following a transformation method as described in PCT Application No. WO 98/01572, and multicellular plant cells (See Schmidt, R. and Willmitzer, L., 1988, High efficiency *Agrobacterium tumefaciens*-mediated transformation of *Arabidopsis thaliana* leaf and cotyledon explants, Plant Cell Rep. 583-586; Plant Molecular Biology and Biotechnology, C Press, Boca Raton, Fla., chapter 6/7, S.71-119 (1993); F. F. White, B. Jenes et al., Techniques for Gene Transfer, in: Transgenic Plants, Vol. 1, Engineering and Utilization, eds. Kung and R. Wu, 128-43, Academic Press: 1993; Potrykus, 1991, Annu. Rev. Plant Physiol. Plant Molec. Biol. 42:205-225 and references cited therein) or mammalian cells. Suitable host cells are discussed further in Goeddel, Gene Expression Technology: Methods in Enzymology 185, Academic Press: San Diego, Calif. (1990). Alternatively, the recombinant expression vector can be transcribed and translated in vitro, for example using 17 promoter regulatory sequences and T7 polymerase.

Expression of polypeptides in prokaryotes is most often carried out with vectors containing constitutive or inducible promoters directing the expression of either fusion or non-fusion polypeptides. Fusion vectors add a number of amino acids to a polypeptide encoded therein, usually to the amino terminus of the recombinant polypeptide but also to the C-terminus or fused within suitable regions in the polypeptides. Such fusion vectors typically serve three purposes: 1) to increase expression of a recombinant polypeptide; 2) to increase the solubility of a recombinant polypeptide; and 3) to aid in the purification of a recombinant polypeptide by acting as a ligand in affinity purification. Often, in fusion expression vectors, a proteolytic cleavage site is introduced at the junction of the fusion moiety and the recombinant polypeptide to enable separation of the recombinant polypeptide from the fusion moiety subsequent to purification of the fusion polypeptide. Such enzymes, and their cognate recognition sequences, include Factor Xa, thrombin, and enterokinase.

By way of example the plant expression cassette can be installed in the pRT transformation vector ((a) Toepfer et al., 1993, Methods Enzymol., 217: 66-78; (b) Toepfer et al. 1987, Nucl. Acids. Res. 15: 5890 ff.).

Alternatively, a recombinant vector (=expression vector) can also be transcribed and translated in vitro, e.g. by using the 17 promoter and the T7 RNA polymerase.

Expression vectors employed in prokaryotes frequently make use of inducible systems with and without fusion proteins or fusion oligopeptides, wherein these fusions can ensue in both N-terminal and C-terminal manner or in other useful domains of a protein. Such fusion vectors usually have the following purposes: i.) to increase the RNA expression rate; ii.) to increase the achievable protein synthesis rate; iii.) to increase the solubility of the protein; iv.) or to simplify purification by means of a binding sequence usable for affinity chromatography. Proteolytic cleavage points are also frequently introduced via fusion proteins, which allow cleavage of a portion of the fusion protein and purification. Such recognition sequences for proteases are recognized, e.g. factor Xa, thrombin and enterokinase.

Typical advantageous fusion and expression vectors are pGEX [Pharmacia Biotech Inc; Smith, D. B. and Johnson, K. S. (1988) Gene 67: 31-40], pMAL (New England Biolabs, Beverly, Mass.) and pRIT5 (Pharmacia, Piscataway, N.J.) which contains glutathione S-transferase (GST), maltose binding protein or protein A.

In one embodiment, the coding sequence of the SRP is cloned into a pGEX expression vector to create a vector encoding a fusion polypeptide comprising, from the N-terminus to the C-terminus, GST-thrombin cleavage site-X polypeptide. The fusion polypeptide can be purified by affinity chromatography using glutathione-agarose resin. Recombinant PKSRP unfused to GST can be recovered by cleavage of the fusion polypeptide with thrombin.

Other examples of *E. coli* expression vectors are pTrc [Amann et al., (1988) Gene 69:301-315] and pET vectors [Studier et al., Gene Expression Technology: Methods in Enzymology 185, Academic Press, San Diego, Calif. (1990) 60-89; Stratagene, Amsterdam, The Netherlands].

Target gene expression from the pTrc vector relies on host RNA polymerase transcription from a hybrid trp-lac fusion promoter. Target gene expression from the pET 11d vector relies on transcription from a T7 gn10-lac fusion promoter mediated by a co-expressed viral RNA polymerase (17 gn1). This viral polymerase is supplied by host strains BL21(DE3) or HMS174(DE3) from a resident X prophage harboring a T7 gn1 gene under the transcriptional control of the lacUV 5 promoter.

One strategy to maximize recombinant polypeptide expression is to express the polypeptide in a host bacteria with an impaired capacity to proteolytically cleave the recombinant polypeptide (Gottesman, S., Gene Expression Technology: Methods in Enzymology 185, Academic Press, San Diego, Calif. (1990) 119-128). Another strategy is to alter the sequence of the nucleic acid to be inserted into an expression vector so that the individual codons for each amino acid are those preferentially utilized in the bacterium chosen for expression, such as *C. glutamicum* (Wada et al., 1992, Nucleic Acids Res. 20:2111-2118). Such alteration of nucleic acid sequences of the invention can be carried out by standard DNA synthesis techniques.

Other advantageous vectors for use in yeast are pYepSec1 (Baldari, et al., (1987) Embo J. 6:229-234), pMFa (Kurjan and Herskowitz, (1982) Cell 30:933-943), pJRY88 (Schultz et al., (1987) Gene 54:113-123), and pYES derivatives (Invitrogen Corporation, San Diego, Calif.). Vectors for use in filamentous fungi are described in: van den Hondel, C. A. M. J. J. & Punt, P. J. (1991) "Gene transfer systems and vector development for filamentous fungi", in: Applied Molecular Genetics of Fungi, J. F. Peberdy, et al., eds., pp. 1-28, Cambridge University Press: Cambridge.

Alternatively, insect cell expression vectors can also be advantageously utilized, e.g. for expression in Sf 9 cells. These are e.g. the vectors of the pAc series (Smith et al. (1983) Mol. Cell. Biol. 3:2156-2165) and the pVL series (Lucklow and Summers (1989) Virology 170:31-39).

Furthermore, plant cells or algal cells can advantageously be used for gene expression. Examples of plant expression vectors may be found in Becker, D., et al. (1992) "New plant binary vectors with selectable markers located proximal to the left border", Plant Mol. Biol. 20: 1195-1197 or in Bevan, M. W. (1984) "Binary *Agrobacterium* vectors for plant transformation", Nucl. Acid. Res. 12: 8711-8721.

Furthermore, the nucleic acid sequences may also be expressed in mammalian cells, advantageously in nonhuman mammalian cells. Examples of corresponding expression vectors are pCDM8 and pMT2PC referred to in: Seed, B. (1987) Nature 329:840 or Kaufman et al. (1987) EMBO J. 6: 187-195). At the same time promoters preferred for use are of viral origin, such as by way of example promoters of polyoma, adenovirus 2, cytomegalovirus or simian virus 40. Other prokaryotic and eukaryotic expression systems are referred to in chapters 16 and 17 of Sambrook et al., Molecular Cloning: A Laboratory Manual. 2nd, ed., Cold Spring Harbor Laboratory, Cold Spring Harbor Laboratory Press, Cold Spring Harbor, N.Y., 1989.

In a preferred embodiment of the present invention, the SRPs are expressed in plants and plants cells such as unicellular plant cells (e.g. algae) (See Falciatore et al., 1999, Marine Biotechnology 1(3):239-251 and references therein) and plant cells from higher plants (e.g., the spermatophytes, such as crop plants). A SRP may be "introduced" into a plant cell by any means, including transfection, transformation or transduction, electroporation, particle bombardment, agroinfection, and the like. One transformation method known to those of skill in the art is the dipping of a flowering plant into an *Agrobacteria* solution, wherein the *Agrobacteria* contains the SRP nucleic acid, followed by breeding of the transformed gametes.

Other suitable methods for transforming or transfecting host cells including plant cells can be found in Sambrook, et al., Molecular Cloning: A Laboratory Manual. $2^{nd}$, ed., Cold Spring Harbor Laboratory, Cold Spring Harbor Laboratory Press, Cold Spring Harbor, N.Y., 1989, and other laboratory manuals such as Methods in Molecular Biology, 1995, Vol. 44, *Agrobacterium* protocols, ed: Gartland and Davey, Humana Press, Totowa, N.J. As biotic and abiotic stress tolerance is a general trait wished to be inherited into a wide variety of plants like maize, wheat, rye, oat, triticale, rice, barley, soybean, peanut, cotton, rapeseed and canola, manihot, pepper, sunflower and tagetes, solanaceous plants like potato, tobacco, eggplant, and tomato, *Vicia* species, pea, alfalfa, bushy plants (coffee, cacao, tea), *Salix* species, trees (oil palm, coconut), perennial grasses, and forage crops, these crop plants are also preferred target plants for a genetic engineering as one further embodiment of the present invention. Forage crops include, but are not limited to, Wheatgrass, Canarygrass, Bromegrass, Wildrye Grass, Bluegrass, Orchardgrass, Alfalfa, Salfoin, Birdsfoot Trefoil, Alsike Clover, Red Clover, and Sweet Clover.

In one embodiment of the present invention, transfection of a SRP into a plant is achieved by *Agrobacterium* mediated gene transfer. *Agrobacterium* mediated plant transformation can be performed using for example the GV3101(pMP90) (Koncz and Schell, 1986, Mol. Gen. Genet. 204:383-396) or LBA4404 (Clontech) *Agrobacterium tumefaciens* strain. Transformation can be performed by standard transformation and regeneration techniques (Deblaere et al., 1994, Nucl. Acids Res. 13:4777-4788; Gelvin, Stanton B. and Schilperoort, Robert A, Plant Molecular Biology Manual, $2^{nd}$ Ed.—Dordrecht: Kluwer Academic Publ., 1995.—in Sect., Ringbuc Zentrale Signatur: BT11-P ISBN 0-7923-2731-4; Glick, Bernard R.; Thompson, John E., Methods in Plant Molecular Biology and Biotechnology, Boca Raton: CRC Press, 1993 360 S., ISBN 0-8493-5164-2). For example, rapeseed can be transformed via cotyledon or hypocotyl transformation (Moloney et al., 1989, Plant cell Report 8:238-242; De Block et al., 1989, Plant Physiol. 91:694-701). Use of antibiotics for *Agrobacterium* and plant selection depends on the binary vector and the *Agrobacterium* strain used for transformation. Rapeseed selection is normally performed using kanamycin as selectable plant marker. *Agrobacterium* mediated gene transfer to flax can be performed using, for example, a technique described by Mlynarova et al., 1994, Plant Cell Report 13:282-285. Additionally, transformation of soybean can be performed using for example a technique described in European Patent No. 0424 047, U.S. Pat. No. 5,322,783, European Patent No. 0397 687, U.S. Pat. No. 5,376,543, or U.S. Pat. No. 5,169,770. Transformation of maize can be achieved by particle bombardment, polyethylene glycol mediated DNA uptake or via the silicon carbide fiber technique. (See, for example, Freeling and Walbot "The maize handbook" Springer Verlag: New York (1993) ISBN 3-540-97826-7). A specific example of maize transformation is found in U.S. Pat. No. 5,990,387, and a specific example of wheat transformation can be found in PCT Application No. WO 93/07256.

According to the present invention, the introduced SRP may be maintained in the plant cell stably if it is incorporated into a non-chromosomal autonomous replicon or integrated into the plant chromosomes. Alternatively, the introduced SRP may be present on an extra-chromosomal non-replicating vector and be transiently expressed or transiently active.

In one embodiment, a homologous recombinant microorganism can be created wherein the SRP is integrated into a chromosome, a vector is prepared which contains at least a portion of a SRP gene into which a deletion, addition, or substitution has been introduced to thereby alter, e.g., functionally disrupt, the SRP gene. Preferably, the SRP gene is a yeast, *E. coli* SRP gene, but it can be a homolog from a related plant or even from a mammalian or insect source. In one embodiment, the vector is designed such that, upon homologous recombination, the endogenous SRP gene is functionally disrupted (i.e., no longer encodes a functional polypeptide; also referred to as a knock-out vector). Alternatively, the vector can be designed such that, upon homologous recombination, the endogenous SRP gene is mutated or otherwise altered but still encodes a functional polypeptide (e.g., the upstream regulatory region can be altered to thereby alter the expression of the endogenous SRP). To create a point mutation via homologous recombination, DNA-RNA hybrids can be used in a technique known as chimeraplasty (Cole-Strauss et al., 1999, Nucleic Acids Research 27(5):1323-1330 and Kmiec, 1999 Gene therapy American Scientist. 87(3):240-247). Homologous recombination procedures in *Physcomitrella patens* are also well known in the art and are contemplated for use herein.

Whereas in the homologous recombination vector, the altered portion of the SRP gene is flanked at its 5' and 3' ends by an additional nucleic acid molecule of the SRP gene to allow for homologous recombination to occur between the exogenous SRP gene carried by the vector and an endogenous SRP gene, in a microorganism or plant. The additional flanking SRP nucleic acid molecule is of sufficient length for successful homologous recombination with the endogenous gene. Typically, several hundreds of base pairs up to kilobases of flanking DNA (both at the 5' and 3' ends) are included in the vector. See, e.g., Thomas, K. R., and Capecchi, M. R., 1987, Cell 51:503 for a description of homologous recombination vectors or Strepp et al., 1998, PNAS, 95 (8):4368-4373 for cDNA based recombination in *Physcomitrella patens*). The vector is introduced into a microorganism or plant cell (e.g., via polyethylene glycol mediated DNA), and cells in which the introduced SRP gene has homologously recombined with the endogenous SRP gene are selected using art-known techniques.

In another embodiment, recombinant microorganisms can be produced that contain selected systems which allow for regulated expression of the introduced gene. For example, inclusion of a SRP gene on a vector placing it under control of the lac operon permits expression of the SRP gene only in the presence of IPTG. Such regulatory systems are well known in the art.

Whether present in an extra-chromosomal non-replicating vector or a vector that is integrated into a chromosome, the SRP polynucleotide preferably resides in a plant expression cassette. A plant expression cassette preferably contains regulatory sequences capable of driving gene expression in plant cells that are operatively linked so that each sequence can fulfill its function, for example, termination of transcription by polyadenylation signals. Preferred polyadenylation signals are those originating from *Agrobacterium tumefaciens* t-DNA such as the gene 3 known as octopine synthase of the Ti-plasmid pTiACH$_5$ (Gielen et al., 1984, EMBO J. 3:835) or functional equivalents thereof but also all other terminators functionally active in plants are suitable. As plant gene expression is very often not limited on transcriptional levels, a plant expression cassette preferably contains other operatively linked sequences like translational enhancers such as the overdrive-sequence containing the 5"-untranslated leader sequence from tobacco mosaic virus enhancing the polypeptide per RNA ratio (Gallie et al., 1987, Nucl. Acids Research 15:8693-8711). Examples of plant expression vectors include those detailed in: Becker, D. et al., 1992, New plant binary vectors with selectable markers located proximal to the left border, Plant Mol. Biol. 20: 1195-1197; and Bevan, M. W., 1984, Binary *Agrobacterium* vectors for plant transformation, Nucl. Acid. Res. 12:8711-8721; and Vectors for Gene Transfer in Higher Plants; in: Transgenic Plants, Vol. 1, Engineering and Utilization, eds.: Kung and R. Wu, Academic Press, 1993, S. 15-38.

"Transformation" is defined herein as a process for introducing heterologous DNA into a plant cell, plant tissue, or plant. It may occur under natural or artificial conditions using various methods well known in the art. Transformation may rely on any known method for the insertion of foreign nucleic acid sequences into aprokaryotic or eukaryotic host cell. The method is selected based on the host cell being transformed and may include, but is not limited to, viral infection, electroporation, lipofection, and particle bombardment. Such "transformed" cells include stably transformed cells in which the inserted DNA is capable of replication either as an autonomously replicating plasmid or as part of the host chromosome. They also include cells which transiently express the inserted DNA or RNA for limited periods of time. Transformed plant cells, plant tissue, or plants are understood to encompass not only the end product of a transformation process, but also transgenic progeny thereof.

The terms "transformed," "transgenic," and "recombinant" refer to a host organism such as a bacterium or a plant into which a heterologous nucleic acid molecule has been introduced. The nucleic acid molecule can be stably integrated into the genome of the host or the nucleic acid molecule can also be present as an extrachromosomal molecule. Such an extrachromosomal molecule can be auto-replicating. Transformed cells, tissues, or plants are understood to encompass not only the end product of a transformation process, but also transgenic progeny thereof. A "non-transformed," "non-transgenic," or "non-recombinant" host refers to a wild-type organism, e.g., a bacterium or plant, which does not contain the heterologous nucleic acid molecule.

A "transgenic plant", as used herein, refers to a plant which contains a foreign nucleotide sequence inserted into either its nuclear genome or organellar genome. It encompasses further the offspring generations i.e. the T1-, T2- and consecutively generations or BC1-, BC2- and consecutively generation as well as crossbreeds thereof with non-transgenic or other transgenic plants.

The host organism (=transgenic organism) advantageously contains at least one copy of the nucleic acid according to the invention and/or of the nucleic acid construct according to the invention.

In principle all plants can be used as host organism. Preferred transgenic plants are, for example, selected from the families Aceraceae, Anacardiaceae, Apiaceae, Asteraceae, Brassicaceae, Cactaceae, Cucurbitaceae, Euphorbiaceae, Fabaceae, Malvaceae, Nymphaeaceae, Papaveraceae, Rosaceae, Salicaceae, Solanaceae, Arecaceae, Bromeliaceae, Cyperaceae, Iridaceae, Liliaceae, Orchidaceae, Gentianaceae, Labiaceae, Magnoliaceae, Ranunculaceae, Carifolaceae, Rubiaceae, Scrophulariaceae, Caryophyllaceae, Ericaceae, Polygonaceae, Violaceae, Juncaceae or Poaceae and preferably from a plant selected from the group of the families Apiaceae, Asteraceae, Brassicaceae, Cucurbitaceae, Fabaceae, Papaveraceae, Rosaceae, Solanaceae, Liliaceae or Poaceae. Preferred are crop plants such as plants advantageously selected from the group of the genus peanut, oilseed rape, canola, sunflower, safflower, olive, sesame, hazelnut, almond, avocado, bay, pumpkin/squash, linseed, soya, pistachio, borage, maize, wheat, rye, oats, sorghum and millet, triticale, rice, barley, cassaya, potato, sugarbeet, egg plant, alfalfa, and perennial grasses and forage plants, oil palm, vegetables (brassicas, root vegetables, tuber vegetables, pod vegetables, fruiting vegetables, onion vegetables, leafy vegetables and stem vegetables), buckwheat, Jerusalem artichoke, broad bean, vetches, lentil, dwarf bean, lupin, clover and Lucerne for mentioning only some of them.

In one preferred embodiment, the host plant is selected from the families Aceraceae, Anacardiaceae, Apiaceae, Asteraceae, Brassicaceae, Cactaceae, Cucurbitaceae, Euphorbiaceae, Fabaceae, Malvaceae, Nymphaeaceae, Papaveraceae, Rosaceae, Salicaceae, Solanaceae, Arecaceae, Bromeliaceae, Cyperaceae, Iridaceae, Liliaceae, Orchidaceae, Gentianaceae, Labiaceae, Magnoliaceae, Ranunculaceae, Carifolaceae, Rubiaceae, Scrophulariaceae, Caryophyllaceae, Ericaceae, Polygonaceae, Violaceae, Juncaceae or Poaceae and preferably from a plant selected from the group of the families Apiaceae, Asteraceae, Brassicaceae, Cucurbitaceae, Fabaceae, Papaveraceae, Rosaceae, Solanaceae, Liliaceae or Poaceae. Preferred are crop plants and in particular plants mentioned herein above as host plants such as the families and genera mentioned above for example preferred the species *Anacardium occidentale, Calendula officinalis, Carthamus tinctorius, Cichorium intybus, Cynara scolymus, Helianthus annus, Tagetes lucida, Tagetes erecta, Tagetes tenuifolia; Daucus carota; Corylus avellana, Corylus colurna, Borago officinalis; Brassica napus, Brassica rapa* ssp., *Sinapis arvensis Brassica juncea, Brassica juncea* var. *juncea, Brassica juncea* var. *crispifolia, Brassica juncea* var. *foliosa, Brassica nigra, Brassica sinapioides, Melanosinapis communis, Brassica oleracea, Arabidopsis thaliana, Anana comosus, Ananas ananas, Bromelia comosa, Carica papaya, Cannabis sative, Ipomoea batatus, Ipomoea pandurata, Convolvulus batatas, Convolvulus tiliaceus, Ipomoea fastigiata, Ipomoea tiliacea, Ipomoea triloba, Convolvulus panduratus, Beta vulgaris, Beta vulgaris* var. *altissima, Beta vulgaris* var. *vulgaris, Beta maritima, Beta vulgaris* var. *perennis, Beta vulgaris* var. *conditiva, Beta vulgaris* var. *esculenta, Cucurbita maxima, Cucurbita mixta, Cucurbita pepo, Cucurbita moschata, Olea europaea, Manihot utilissima, Janipha manihot, Jatropha manihot, Manihot aipil, Manihot dulcis, Manihot manihot, Manihot melanobasis, Manihot esculenta, Ricinus communis, Pisum sativum, Pisum arvense, Pisum humile, Medicago sativa, Medicago falcata, Medicago varia, Glycine max Dolichos soja, Glycine gracilis, Glycine hispida, Phaseolus max, Soja hispida, Soja max, Cocos nucifera, Pelargonium grossularioides, Oleum cocoas, Laurus nobilis, Persea americana, Arachis hypogaea, Linum usitatissimum, Linum humile, Linum austriacum, Linum bienne, Linum angustifolium, Linum catharticum, Linum flavum, Linum grandiflorum, Adenolinum grandiflorum, Linum lewisii, Linum narbonense, Linum perenne, Linum perenne* var. *lewisii, Linum pratense, Linum trigynum, Punica granatum, Gossypium hirsutum, Gossypium arboreum, Gossypium barbadense, Gossypium herbaceum, Gossypium thurberi, Musa nana, Musa acuminata, Musa paradisiaca, Musa* spp., *Elaeis guineensis, Papaver orientale, Papaver rhoeas, Papaver dubium, Sesamum indicum, Piper aduncum, Piper amalago, Piper angustifolium, Piper auritum, Piper betel, Piper cubeba, Piper longum, Piper nigrum, Piper retrofractum, Artanthe adunca, Artanthe elongata, Peperomia elongata, Piper elongatum, Steffensia elongata, Hordeum vulgare, Hordeum jubatum, Hordeum murinum, Hordeum secalinum, Hordeum distchon Hordeum aegiceras, Hordeum hexastichon, Hordeum hexastichum, Hordeum irregulare, Hordeum sativum, Hordeum secalinum, Avena sativa, Avena fatua, Avena byzantina, Avena fatua* var. *sativa, Avena hybrida, Sorghum bicolor, Sorghum halepense, Sorghum saccharatum, Sorghum vulgare, Andropogon drummondii, Holcus bicolor, Holcus sorghum, Sorghum aethiopicum, Sorghum arundinaceum, Sorghum caffrorum, Sorghum cernuum, Sorghum dochna, Sorghum drummondii, Sorghum durra, Sorghum guineense, Sorghum lanceolatum, Sorghum nervosum, Sorghum saccharatum, Sorghum subglabrescens, Sorghum verticilliflorum, Sorghum vulgare, Holcus halepensis, Sorghum miliaceum millet, Panicum militaceum, Zea mays, Triticum aestivum, Triticum durum, Triticum turgidum, Triticum hybernum, Triticum macha, Triticum sativum* or *Triticum vulgare, Cofea* spp., *Coffea arabica, Coffea canephora, Coffea liberica, Capsicum annuum, Capsicum annuum* var. *glabriusculum, Capsicum frutescens, Capsicum annuum, Nicotiana tabacum, Solanum tuberosum, Solanum melongena, Lycopersicon esculentum, Lycopersicon lycopersicum, Lycopersicon pyriforme, Solanum integrifolium, Solanum lycopersicum Theobroma cacao* or *Camellia sinensis.*

Anacardiaceae such as the genera *Pistacia, Mangifera, Anacardium* e.g. the species *Pistacia* vera [pistachios, Pistazie], *Mangifer indica* [Mango] or *Anacardium occidentale* [Cashew]; Asteraceae such as the genera *Calendula, Carthamus, Centaurea, Cichorium, Cynara, Helianthus, Lactuca, Locusta, Tagetes, Valeriana* e.g. the species *Calendula officinalis* [Marigold], *Carthamus tinctorius* [safflower], *Centaurea cyanus* [cornflower], *Cichorium intybus* [blue daisy],

*Cynara scolymus* [Artichoke], *Helianthus annus* [sunflower], *Lactuca sativa, Lactuca crispa, Lactuca esculenta, Lactuca scariola* L. ssp. *sativa, Lactuca scariola* L. var. *integrata, Lactuca scariola* L. var. *integrifolia, Lactuca sativa* subsp. *romana, Locusta communis, Valeriana locusta* [lettuce], *Tagetes lucida, Tagetes erecta* or *Tagetes tenuifolia* [Marigold]; Apiaceae such as the genera *Daucus* e.g. the species *Daucus carota* [carrot]; Betulaceae such as the genera *Corylus* e.g. the species *Coryius avellana* or *Corylus columa* [hazelnut]; Boraginaceae such as the genera *Borago* e.g. the species *Borago officinalis* [borage]; Brassicaceae such as the genera *Brassica, Melanosinapis, Sinapis, Arabadopsis* e.g. the species *Brassica napus, Brassica rapa* ssp. [canola, oilseed rape, turnip rape], *Sinapis arvensis Brassica juncea, Brassica juncea* var. *juncea, Brassica juncea* var. *crispifolia, Brassica juncea* var. *foliosa, Brassica nigra, Brassica sinapioides, Melanosinapis communis* [mustard], *Brassica oleracea* [fodder beet] or *Arabidopsis thaliana*; Bromeliaceae such as the genera *Anana, Bromelia* e.g. the species *Anana comosus, Ananas ananas* or *Bromelia comosa* [pineapple]; Caricaceae such as the genera *Carica* e.g. the species *Carica papaya* [papaya]; Cannabaceae such as the genera *Cannabis* e.g. the species *Cannabis sative* [hemp], Convolvulaceae such as the genera *Ipomoea, Convolvulus* e.g. the species *Ipomoea batatus, Ipomoea pandurata, Convolvulus batatas, Convolvulus tiliaceus, Ipomoea fastigiata, Ipomoea tiliacea, Ipomoea triloba* or *Convolvulus panduratus* [sweet potato, Man of the Earth, wild potato], Chenopodiaceae such as the genera *Beta*, i.e. the species *Beta vulgaris, Beta vulgaris* var. *altissima, Beta vulgaris* var. *Vulgaris, Beta maritima, Beta vulgaris* var. *perennis, Beta vulgaris* var. *conditiva* or *Beta vulgaris* var. *esculenta* [sugar beet]; Cucurbitaceae such as the genera *Cucubita* e.g. the species *Cucurbita maxima, Cucurbita mixta, Cucurbita pepo* or *Cucurbita moschata* [pumpkin, squash]; Elaeagnaceae such as the genera *Elaeagnus* e.g. the species *Olea europaea* [olive]; Ericaceae such as the genera *Kalmia* e.g. the species *Kalmia latifolia, Kalmia angustifolia, Kalmia microphylla, Kalmia polifolia, Kalmia occidentalis, Cistus chamaerhodendros* or *Kalmia lucida* [American laurel, broad-leafed laurel, calico bush, spoon wood, sheep laurel, alpine laurel, bog laurel, western bog-laurel, swamp-laurel]; Euphorbiaceae such as the genera *Manihot, Janipha, Jatropha, Ricinus* e.g. the species *Manihot utilissima, Janipha manihot, Jatropha manihot, Manihot aipil, Manihot dulcis, Manihot manihot, Manihot melanobasis, Manihot esculenta [manihot*, arrowroot, tapioca, cassaya] or *Ricinus communis* [castor bean, Castor Oil Bush, Castor Oil Plant, Palma Christi, Wonder Tree]; Fabaceae such as the genera *Pisum, Albizia, Cathormion, Feuillea, Inga, Pithecolobium, Acacia, Mimosa, Medicajo, Glycine, Dolichos, Phaseolus, Soja* e.g. the species *Pisum sativum, Pisum arvense, Pisum humile* [pea], *Albizia berteriana, Albizia julibrissin, Albizia lebbeck, Acacia berteriana, Acacia littoralis, Albizia berteriana, Albizzia berteriana, Cathormion berteriana, Feuillea berteriana, Inga fragrans, Pithecellobium berterianum, Pithecellobium fragrans, Pithecolobium berterianum, Pseudalbizzia berteriana, Acacia julibrissin, Acacia nemu, Albizia nemu, Feuilleea julibrissin, Mimosa julibrissin, Mimosa speciosa, Sericanrda julibrissin, Acacia lebbeck, Acacia macrophylla, Albizia lebbek, Feuilleea lebbeck, Mimosa lebbeck, Mimosa speciosa* [bastard logwood, silk tree, East Indian Walnut], *Medicago sativa, Medicago falcata, Medicago varia* [alfalfa]*Glycine max Dolichos soja, Glycine gracilis, Glycine hispida, Phaseolus max, Soja hispida* or *Soja max* [soybean]; Geraniaceae such as the genera *Pelargonium, Cocos, Oleum* e.g. the species *Cocos nucifera, Pelargonium grossularioides* or *Oleum cocois* [coconut]; Gramineae such as the genera *Saccharum* e.g. the species *Saccharum officinarum*; Juglandaceae such as the genera *Juglans, Wallia* e.g. the species *Juglans regia, Juglans ailanthifolia, Juglans sieboldiana, Juglans cinerea, Wallia cinerea, Juglans bixbyi, Juglans californica, Juglans hindsii, Juglans intermedia, Juglans jamaicensis, Juglans major, Juglans microcarpa, Juglans nigra* or *Wallia nigra* [walnut, black walnut, common walnut, persian walnut, white walnut, butternut, black walnut]; Lauraceae such as the genera *Persea, Laurus* e.g. the species laurel *Laurus nobilis* [bay, laurel, bay laurel, sweet bay], *Persea americana Persea americana, Persea gratissima* or *Persea persea* [avocado]; Leguminosae such as the genera *Arachis* e.g. the species *Arachis hypogaea* [peanut]; Linaceae such as the genera *Linum, Adenolinum* e.g. the species *Linum usitatissimum, Linum humile, Unum austriacum, Linum bienne, Unum angustifolium, Linum catharticum, Unum flavum, Linum grandiflorum, Adenolinum grandiflorum, Linum lewisii, Linum narbonense, Linum perenne, Linum perenne* var. *lewisii, Linum pratense* or *Linum trigynum* [flax, linseed]; Lythrarieae such as the genera *Punica* e.g. the species *Punica granatum* [pomegranate]; Malvaceae such as the genera *Gossypium* e.g. the species *Gossypium hirsutum, Gossypium arboreum, Gossypium barbadense, Gossypium herbaceum* or *Gossypium thurberi* [cotton]; Musaceae such as the genera *Musa* e.g. the species *Musa nana, Musa acuminata, Musa paradisiaca, Musa* spp. [banana]; Onagraceae such as the genera *Camissonia, Oenothera* e.g. the species *Oenothera biennis* or *Camissonia brevipes* [primrose, evening primrose]; Palmae such as the genera *Elacis* e.g. the species *Elaeis guineensis* [oil plam]; Papaveraceae such as the genera *Papaver* e.g. the species *Papaver orientale, Papaver rhoeas, Papaver dubium* [poppy, oriental poppy, corn poppy, field poppy, shirley poppies, field poppy, long-headed poppy, long-pod poppy]; Pedaliaceae such as the genera *Sesamum* e.g. the species *Sesamum indicum* [sesame]; Piperaceae such as the genera *Piper, Artanthe, Peperomia, Steffensia* e.g. the species *Piper aduncum, Piper amalago, Piper angustifolium, Piper auritum, Piper betel, Piper cubeba, Piper longum, Piper nigrum, Piper retrofractum, Artanthe adunca, Artanthe elongate, Peperomia elongate, Piper elongatum, Steffensia elongate.* [Cayenne pepper, wild pepper]; Poaceae such as the genera *Hordeum, Secale, Avena, Sorghum, Andropogon, Holcus, Panicum, Oryza, Zea, Triticum* e.g. the species *Hordeum vulgare, Hordeum jubatum, Hordeum murinum, Hordeum secalinum, Hordeum distichon Hordeum aegiceras, Hordeum hexastichon, Hordeum hexastichum, Hordeum irregulare, Hordeum sativum, Hordeum secalinum* [barley, pearl barley, foxtail barley, wall barley, meadow barley], *Secale cereale* [rye], *Avena sativa, Avena fatua, Avena byzantina, Avena fatua* var. *sativa, Avena hybrida* [oat], *Sorghum bicolor, Sorghum halepense, Sorghum saccharatum, Sorghum vulgare, Andropogon drummondii, Holcus bicolor, Holcus sorghum, Sorghum aethiopicum, Sorghum arundinaceum, Sorghum caffrorum, Sorghum cernuum, Sorghum dochna, Sorghum drummondii, Sorghum durra, Sorghum guineense, Sorghum lanceolatum, Sorghum nervosum, Sorghum saccharatum, Sorghum subglabrescens, Sorghum verticilliflorum, Sorghum vulgare, Holcus halepensis, Sorghum miliaceum millet, Panicum militaceum* [Sorghum, millet], *Oryza saliva, Oryza latifolia* [rice], *Zea mays* [corn, maize] *Triticum aestivum, Triticum durum, Triticum turgidum, Triticum hybemum, Triticum macha, Triticum sativum* or *Triticum vulgare* [wheat, bread wheat, common wheat], Proteaceae such as the genera *Macadamia* e.g. the species *Macadamia intergrifolia [macadamia]*; Rubiaceae such as the genera *Coffea* e.g. the species *Cofea* spp., *Coffea arabica, Coffea canephora* or *Coffea liberica* [coffee]; Scrophulariaceae such as the genera *Verbascum* e.g. the species *Verbascum blattaria, Verbascum chaixii, Verbascum densiflorum, Verbascum lagurus, Verbascum longifolium, Verbascum lychnitis, Verbascum nigrum, Verbascum olympicum, Verbascum phlomoides, Verbascum phoenicum, Verbascum pulverulentum* or *Verbascum thapsus* [mullein, white moth mullein, nettle-leaved mullein, dense-flowered mullein, silver mullein, long-leaved mullein, white mullein, dark mullein, greek mullein, orange mullein, purple mullein, hoary mullein, great mullein]; Solanaceae such as the genera *Capsicum, Nicotiana, Solanum, Lycopersicon* e.g. the species *Capsicum annuum, Capsicum annuum* var. *glabriusculum, Capsicum frutescens* [pepper], *Capsicum annuum* [paprika], *Nicotiana tabacum, Nicotiana alata, Nicotiana attenuata, Nicotiana glauca, Nicotiana langsdorffli, Nicotiana obtusifolia, Nicotiana quadrivalvis, Nicotiana repanda, Nicotiana rustica, Nicotiana sylvestris* [tobacco], *Solanum tuberosum* [potato], *Solanum melongena* [eggplant] (*Lycopersicon esculentum, Lycopersicon lycopersicum, Lycopersicon pyriforme, Solanum integrifolium* or *Solanum lycopersicum* [tomato]; Sterculiaceae such as the genera *Theobroma* e.g. the species *Theobroma cacao* [cacao]; Theaceae such as the genera *Camellia* e.g. the species *Camellia sinensis*) [tea].

The introduction of the nucleic acids according to the invention, the expression cassette or the vector into organisms, plants for example, can in principle be done by all of the methods known to those skilled in the art. The introduction of the nucleic acid sequences gives rise to recombinant or transgenic organisms.

In the case of microorganisms, those skilled in the art can find appropriate methods in the textbooks by Sambrook, J. et al. (1989) Molecular cloning: A laboratory manual, Cold Spring Harbor Laboratory Press, by F. M. Ausubel et al. (1994) Current protocols in molecular biology, John Wiley and Sons, by D. M. Glover et al., DNA Cloning Vol. 1, (1995), IRL Press (ISBN 019-963476-9), by Kaiser et al. (1994) Methods in Yeast Genetics, Cold Spring Harbor Laboratory Press or Guthrie et al. Guide to Yeast Genetics and Molecular Biology, Methods in Enzymology, 1994, Academic Press.

The transfer of foreign genes into the genome of a plant is called transformation. In doing this the methods described for the transformation and regeneration of plants from plant tissues or plant cells are utilized for transient or stable transformation. Suitable methods are protoplast transformation by poly(ethylene glycol)-induced DNA uptake, the "biolistic" method using the gene cannon—referred to as the particle bombardment method, electroporation, the incubation of dry embryos in DNA solution, microinjection and gene transfer mediated by *Agrobacterium*. Said methods are described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol.

Plant Molec. Biol. 42 (1991) 205-225). The nucleic acids or the construct to be expressed is preferably cloned into a vector which is suitable for transforming *Agrobacterium tumefaciens*, for example pBin19 (Bevan et al., Nucl. Acids Res. 12 (1984) 8711). *Agrobacteria* transformed by such a vector can then be used in known manner for the transformation of plants, in particular of crop plants such as by way of example tobacco plants, for example by bathing bruised leaves or chopped leaves in an agrobacterial solution and then culturing them in suitable media. The transformation of plants by means of *Agrobacterium tumefaciens* is described, for example, by Höfgen and Willmitzer in Nucl: Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

*Agrobacteria* transformed by an expression vector according to the invention may likewise be used in known manner for the transformation of plants such as test plants like *Arabidopsis* or crop plants such as cereal crops, corn, oats, rye, barley, wheat, soybean, rice, cotton, sugar beet, canola, sunflower, flax, hemp, potatoes, tobacco, tomatoes, carrots, paprika, oilseed rape, tapioca, cassava, arrowroot, tagetes, alfalfa, lettuce and the various tree, nut and vine species, in particular of oil-containing crop plants such as soybean, peanut, castor oil plant, sunflower, corn, cotton, flax, oilseed rape, coconut, oil palm, safflower (*Carthamus tinctorius*) or cocoa bean, e.g. by bathing bruised leaves or chopped leaves in an agrobacterial solution and then culturing them in suitable media.

The genetically modified plant cells may be regenerated by all of the methods known to those skilled in the art. Appropriate methods can be found in the publications referred to above by S. D. Kung and R. Wu, Potrykus or Höfgen and Willmitzer.

Accordingly, a further aspect of the invention relates to transgenic organisms transformed by at least one nucleic acid sequence, expression cassette or vector according to the invention as well as cells, cell cultures, tissue, parts—such as, for example, leaves, roots, etc. in the case of plant organisms—or reproductive material derived from such organisms. The terms "host organism", "host cell", "recombinant (host) organism" and "transgenic (host) cell" are used here interchangeably. Of course these terms relate not only to the particular host organism or the particular target cell but also to the descendants or potential descendants of these organisms or cells. Since, due to mutation or environmental effects certain modifications may arise in successive generations, these descendants need not necessarily be identical with the parental cell but nevertheless are still encompassed by the term as used here.

For the purposes of the invention "transgenic" or "recombinant" means with regard for example to a nucleic acid sequence, an expression cassette (=gene construct, nucleic acid construct) or a vector containing the nucleic acid sequence according to the invention or an organism transformed by the nucleic acid sequences, expression cassette or vector according to the invention all those constructions produced by genetic engineering methods in which either a) the nucleic acid sequence depicted SEQ ID NO: (4n+1) for n=0 to 54 and (2n+1) for n=110 to 487 or its derivatives or parts thereof or b) a genetic control sequence functionally linked to the nucleic acid sequence described under (a), for example a 3'- and/or 5'-genetic control sequence such as a promoter or terminator, or c) (a) and (b)

are not found in their natural, genetic environment or have been modified by genetic engineering methods, wherein the modification may by way of example be a substitution, addition, deletion, inversion or insertion of one or more nucleotide residues. Natural genetic environment means the natural genomic or chromosomal locus in the organism of origin or inside the host organism or presence in a genomic library. In the case of a genomic library the natural genetic environment of the nucleic acid sequence is preferably retained at least in part. The environment borders the nucleic acid sequence at least on one side and has a sequence length of at least 50 bp, preferably at least 500 bp, particularly preferably at least 1,000 bp, most particularly preferably at least 5,000 bp. A naturally occurring expression cassette—for example the naturally occurring combination of the natural promoter of the nucleic acid sequence according to the invention with the corresponding Δ-8-desaturase, Δ-9-elongase and/or Δ-5-desaturase gene—turns into a transgenic expression cassette when the latter is modified by unnatural, synthetic ("artificial") methods such as by way of example a mutagenation. Appropriate methods are described by way of example in U.S. Pat. No. 5,565,350 or WO 00/15815.

Suitable organisms or host organisms for the nucleic acid, expression cassette or vector according to the invention are advantageously in principle all organisms, which are suitable for the expression of recombinant genes as described above. Further examples which may be mentioned are plants such as *Arabidopsis, Asteraceae* such as *Calendula* or crop plants such as soybean, peanut, castor oil plant, sunflower, flax, corn, cotton, flax, oilseed rape, coconut, oil palm, safflower (*Carthamus tinctorius*) or cocoa bean.

A further object of the invention relates to the use of a nucleic acid construct, e.g. an expression cassette, containing DNA sequences encoding polypeptides of SEQ ID NO: (4n+2) for n=0 to 54 and (2n+2) for n=110 to 487 or DNA sequences hybridizing therewith for the transformation of plant cells, tissues or parts of plants.

In doing so, depending on the choice of promoter, the sequences of SEQ ID NO: (4n+2) for n=0 to 54 and (2n+2) for n=110 to 487 can be expressed specifically in the leaves, in the seeds, the nodules, in roots, in the stem or other parts of the plant. Those transgenic plants overproducing sequences SEQ ID NO: (4n+2) for n=0 to 54 and (2n+2) for n=110 to 487, the reproductive material thereof, together with the plant cells, tissues or parts thereof are a further object of the present invention.

The expression cassette or the nucleic acid sequences or construct according to the invention containing sequences according to SEQ ID NO: (4n+1) for n=0 to 54 and (2n+1) for n=110 to 487 can, moreover, also be employed for the transformation of the organisms identified by way of example above such as bacteria, yeasts, filamentous fungi and plants.

Within the framework of the present invention, increased tolerance and/or resistance to environmental stress means, for example, the artificially acquired trait of increased biosynthetic performance due to functional over expression of sequences of SEQ ID NO: (4n+2) for n=0 to 54 and (2n+2) for n=110 to 487 encoded by SEQ ID NO: (4n+1) for n=0 to 54 and (2n+1) for n=110 to 487 and/or homologs in the organisms according to the invention, advantageously in the transgenic plants according to the invention, by comparison with the nongenetically modified initial plants at least for the duration of at least one plant generation.

A constitutive expression of the exogenous sequences of the SEQ ID NO: (4n+2) for n=0 to 54 and (2n+2) for n=110 to 487 encoded by SEQ ID NO: (4n+1) for n=0 to 54 and (2n+1) for n=110 to 487 and/or 217 and/or homologs is, moreover, advantageous. On the other hand, however, an inducible expression may also appear desirable.

The efficiency of the expression of the sequences of the of the SEQ ID NO: (4n+2) for n=0 to 54 and (2n+2) for n=110 to 487 encoded by SEQ ID NO: (4n+1) for n=0 to 54 and (2n+1) for n=110 to 487 and/or homologs can be determined, for example, in vitro by shoot meristem propagation. In addition, an expression of the sequences of the SEQ ID NO: (4n+2) for n=0 to 54 and (2n+2) for n=110 to 487 encoded by SEQ ID NO: (4n+1) for n=0 to 54 and (2n+1) for n=110 to 487 and/or homologs modified in nature and level and its effect on the metabolic pathways performance can be tested on test plants in greenhouse trials.

An additional object of the invention comprises transgenic organisms such as transgenic plants transformed by an expression cassette containing sequences of SEQ ID NO: (4n+1) for n=0 to 54 and (2n+1) for n=110 to 487 according to the invention or DNA sequences hybridizing therewith, as well as transgenic cells, tissue, parts and reproduction material of such plants. Particular preference is given in this case to transgenic crop plants such as by way of example barley, wheat, rye, oats, corn, soybean, rice, cotton, sugar beet, oilseed rape and canola, sunflower, flax, hemp, thistle, potatoes, tobacco, tomatoes, tapioca, cassava, arrowroot, alfalfa, lettuce and the various tree, nut and vine species.

For the purposes of the invention plants are mono- and dicotyledonous plants, mosses or algae.

A further refinement according to the invention are transgenic plants as described above which contain a nucleic acid sequence or construct according to the invention or a expression cassette according to the invention.

Furthermore, by derivatives is meant homologues of the sequences of SEQ ID NO: (4n+1) for n=0 to 54 and (2n+1) for n=110 to 487, for example eukaryotic homologues, truncated sequences, single-stranded DNA of the encoding and nonencoding DNA sequence or RNA of the encoding and nonencoding DNA sequence.

In addition, by homologues of the sequences of SEQ ID NO: (4n+1) for n=0 to 54 and (2n+1) for n=110 to 487 is meant derivatives such as by way of example promoter variants. These variants may be modified by one or more nucleotide exchanges, by insertion(s) and/or deletion(s) without, however, adversely affecting the functionality or efficiency of the promoters. Furthermore, the promoters can have their efficiency increased by altering their sequence or be completely replaced by more effective promoters even of foreign organisms.

By derivatives is also advantageously meant variants whose nucleotide sequence has been altered in the region from −1 to −2000 ahead of the start codon in such a way that the gene expression and/or the protein expression is modified, preferably increased. Furthermore, by derivatives is also meant variants which have been modified at the 3' end.

Suitable promoters in the expression cassette are in principle all promoters which can control the expression of foreign genes in organisms such as microorganisms like protozoa such as ciliates, algae such as green, brown, red or blue algae such as Euglenia, bacteria such as gram-positive or gram-negative bacteria, yeasts such as *Saccharomyces, Pichia* or *Schizosaccharomyces* or fungi such as *Mortierella, Thraustochytrium* or *Schizochytrium* or plants, advantageously in plants or fungi. Use is preferably made in particular of plant promoters or promoters derived from a plant virus. Advantageous regulation sequences for the method according to the invention are found for example in promoters such as cos, tac, trp, tet, trp-tet, lpp, lac, lpp-lac, laclq-, T7, T5, T3, gal, trc, ara, SP6, λ-PR or in λ-PL promoters which are employed advantageously in gram-negative bacteria. Other advantageous regulation sequences are found, for example, in the gram-positive promoters amy and SPO2, in the yeast or fungal promoters ADC1, MFα, AC, P-60, CYC1, GAPDH, TEF, rp28, ADH or in the plant promoters CaMV/35S [Franck et al., Cell 21 (1980) 285-294], SSU, OCS, lib4, STLS1, B33, nos (=Nopalin Synthase Promoter) or in the ubiquintin or phaseolin promoter. The expression cassette may also contain a chemically inducible promoter by means of which the expression of the exogenous sequences of the SEQ ID NO: (4n+1) for n=0 to 54 and (2n+1) for n=110 to 487 in the organisms can be controlled advantageously in the plants at a particular time. Advantageous plant promoters of this type are by way of example the PRP1 promoter [Ward et al., Plant. Mol. Biol. 22 (1993), 361-366], a promoter inducible by benzenesulfonamide (EP 388 186), a promoter inducible by tetracycline [Gatz et al., (1992) Plant J. 2, 397-404], a promoter inducible by salicylic acid (WO 95/19443), a promoter inducible by abscisic acid (EP 335 528) and a promoter inducible by ethanol or cyclohexanone (WO93/21334). Other examples of plant promoters which can advantageously be used are the promoter of cytosolic FBPase from potato, the ST-LSI promoter from potato (Stodthaus et al., EMBO J. 8 (1989) 2445-245), the promoter of phosphoribosyl pyrophosphate amidotransferase from *Glycine max* (see also gene bank accession number U87999) or a nodiene-specific promoter as described in EP 249 676. Particularly advantageous are those plant promoters which ensure expression in tissues or plant parts/organs in which fatty acid biosynthesis or the precursor stages thereof occurs, as in endosperm or in the developing embryo for example. Particularly noteworthy are advantageous promoters which ensure seed-specific expression such as by way of example the USP promoter or derivatives thereof, the LEB4 promoter, the phaseolin promoter or the napin promoter. The particularly advantageous USP promoter cited according to the invention or its derivatives mediate very early gene expression in seed development [Baeumlein et al., Mol Gen Genet, 1991, 225 (3): 459-67]. Other advantageous seed-specific promoters which may be used for monocotylodonous or dicotylodonous plants are the promoters suitable for dicotylodons such as napin gene promoters, likewise cited by way of example, from oilseed rape (U.S. Pat. No. 5,608,152), the oleosin promoter from *Arabidopsis* (WO 98/45461), the phaseolin promoter from *Phaseolus vulgaris* (U.S. Pat. No. 5,504,200), the Bce4 promoter from *Brassica* (WO 91/13980) or the leguminous B4 promoter (LeB4, Baeumlein et al., Plant J., 2, 2, 1992: 233-239) or promoters suitable for monocotylodons such as the promoters of the lpt2 or lpt1 gene in barley (WO 95/15389 and WO 95/23230) or the promoters of the barley hordeine gene, the rice glutelin gene, the rice oryzin gene, the rice prolamin gene, the wheat gliadin gene, the white glutelin gene, the corn zein gene, the oats glutelin gene, the sorghum kasirin gene or the rye secalin gene which are described in WO99/16890.

Furthermore, particularly preferred are those promoters, which ensure the expression in tissues, or plant parts in which, for example, the biosynthesis of fatty acids, oils and lipids or the precursor stages thereof takes place. Particularly noteworthy are promoters, which ensure a seed-specific expression. Noteworthy are the promoter of the napin gene from oilseed rape (U.S. Pat. No. 5,608,152), the USP promoter from *Vicia faba* (USP=unknown seed protein, Baeumlein et al., Mol Gen Genet, 1991, 225 (3): 459-67), the promoter of the oleosin gene from *Arabidopsis* (WO98/45461), the phaseolin promoter (U.S. Pat. No. 5,504,200) or the promoter of the legumin B4 gene (LeB4; Baeumlein et al., 1992, Plant Journal, 2 (2): 233-9). Other promoters to be mentioned are that of the lpt2 or lpt1 gene from barley (WO95/15389 and WO95/23230) which mediate seed-specific expression in monocotyledonous plants. Other advantageous seed specific promoters are promoters such as the promoters from rice, corn or wheat disclosed in WO 99/16890 or Amy32b, Amy6-6 or aleurain (U.S. Pat. No. 5,677,474), Bce4 (rape, U.S. Pat. No. 5,530, 149), glycinin (soy bean, EP 571 741), phosphoenol pyruvat carboxylase (soy bean, JP 06162870), ADR12-2 (soy bean, WO 98/08962), isocitratlyase (rape, U.S. Pat. No. 5,689,040) or β-amylase (barley, EP 781 849).

As described above, the expression construct (=gene construct, nucleic acid construct) may contain yet other genes, which are to be introduced into the organisms. These genes can be subject to separate regulation or be subject to the same regulation region as sequences of SEQ ID NO: (4n+1) for n=0 to 54 and (2n+1) for n=110 to 487. These genes are by way of example other biosynthesis genes, advantageously for fatty acid biosynthesis, vitamin biosynthesis etc. that allow increased synthesis.

In principle all natural promoters with their regulation sequences can be used like those named above for the expression cassette according to the invention and the method according to the invention. Over and above this, synthetic promoters may also advantageously be used.

In the preparation of an expression cassette various DNA fragments can be manipulated in order to obtain a nucleotide sequence, which usefully reads in the correct direction and is equipped with a correct reading raster. To connect the DNA fragments (=nucleic acids according to the invention) to one another adaptors or linkers may be attached to the fragments.

The promoter and the terminator regions can usefully be provided in the transcription direction with a linker or polylinker containing one or more restriction points for the insertion of this sequence. Generally, the linker has 1 to 10, mostly 1 to 8, preferably 2 to 6, restriction points. In general the size of the linker inside the regulatory region is less than 100 bp, frequently less than 60 bp, but at least 5 bp. The promoter may be both native or homologous as well as foreign or heterologous to the host organism, for example to the host plant. In the 5'-3' transcription direction the expression cassette contains the promoter, a DNA sequence which encodes of SEQ ID NO: (4n+1) for n=0 to 54 and (2n+1) for n=110 to 487 gene and a region for transcription termination. Different termination regions can be exchanged for one another in any desired fashion.

Furthermore, manipulations which provide suitable restriction interfaces or which remove excess DNA or restriction interfaces can be employed. Where insertions, deletions or substitutions, such as transitions and transversions, come into consideration, in vitro mutagenesis, primer repair, restriction or ligation may be used. In suitable manipulations such as restriction, chewing back or filling of overhangs for blunt ends complementary ends of the fragments can be provided for the ligation.

For an advantageous high expression the attachment of the specific ER retention signal SEKDEL inter alia can be of importance (Schouten, A. et al., Plant Mol. Biol. 30 (1996), 781-792). In this way the average expression level is tripled or even quadrupled. Other retention signals which occur naturally in plant and animal proteins located in the ER may also be employed for the construction of the cassette. In another preferred embodiment a plastidial targeting sequence is used as described by Napier J. A. [Targeting of foreign proteins to the chloroplast, Methods Mol. Biol., 49, 1995: 369-376]. A preferred used vector comprising said plastidial targeting sequence is disclosed by Colin Lazarus [Guerineau F., Woolston S., Brooks L, Mullineaux P. "An expression cassette for targeting foreign proteins into chloroplast; Nucleic. Acids Res., December 9, 16 (23), 1988: 11380].

Preferred polyadenylation signals are plant polyadenylation signals, preferably those which substantially correspond to T-DNA polyadenylation signals from *Agrobacterium tumefaciens*, in particular gene 3 of the T-DNA (octopin synthase) of the Ti plasmid pTiACH$_5$ (Gielen et al., EMBO J. 3 (1984), 835 et seq.) or corresponding functional equivalents.

An expression cassette is produced by fusion of a suitable promoter with suitable sequences of SEQ ID NO: (4n+1) for n=0 to 54 and (2n+1) for n=110 to 487 together with a polyadenylation signal by common recombination and cloning techniques as described, for example, in T. Maniatis, E. F.

Fritsch and J. Sambrook, Molecular Cloning: A Laboratory Manual, Cold Spring Harbor Laboratory, Cold Spring Harbor, N.Y. (1989) as well as in T. J. Silhavy, M. L. Berman and L. W. Enquist, Experiments with Gene Fusions, Cold Spring Harbor Laboratory, Cold Spring Harbor, N.Y. (1984) and in Ausubel, F. M. et al., Current Protocols in Molecular Biology, Greene Publishing Assoc. and Wiley-Interscience (1987).

In the preparation of an expression cassette various DNA fragments can be manipulated to produce a nucleotide sequence which usefully reads in the correct direction and is equipped with a correct reading raster. Adapters or linkers can be attached to the fragments for joining the DNA fragments.

The promoter and the terminator regions can usefully be provided in the transcription direction with a linker or polylinker containing one or more restriction points for the insertion of this sequence. Generally, the linker has 1 to 10, mostly 1 to 8, preferably 2 to 6, restriction points. In general the size of the linker inside the regulatory region is less than 100 bp, frequently less than 60 bp, but at least 5 bp. The promoter may be both native or homologous as well as foreign or heterologous to the host organism, for example to the host plant. In the 5'-3' transcription direction the expression cassette contains the promoter, a DNA sequence which either encodes gene of the SEQ ID NO: (4n+1) for n=0 to 54 and (2n+1) for n=110 to 487 and a region for transcription termination. Different termination regions can be exchanged for one another in any desired fashion.

In the preparation of an expression cassette various DNA fragments can be manipulated to produce a nucleotide sequence which usefully reads in the correct direction and is equipped with a correct reading raster. Adapters or linkers can be attached to the fragments for joining the DNA fragments.

The DNA sequences encoding the nucleic acid sequences used in the inventive processes such as the sequences of SEQ ID NO: (4n+1) for n=0 to 54 and (2n+1) for n=110 to 487 contain all the sequence characteristics needed to achieve correct localization of respective biosynthesis. Accordingly, no further targeting sequences are needed per se. However, such a localization may be desirable and advantageous and hence artificially modified or reinforced so that such fusion constructs are also a preferred advantageous embodiment of the invention.

Particularly preferred are sequences which ensure targeting in plastids. Under certain circumstances targeting into other compartments (reported in: Kermode, Crit. Rev. Plant Sci. 15, 4 (1996), 285-423) may also be desirable, e.g. into vacuoles, the mitochondrium, the endoplasmic reticulum (ER), peroxisomes, lipid structures or due to lack of corresponding operative sequences retention in the compartment of origin, the cytosol.

As used herein, the term "environmental stress" refers to any sub-optimal growing condition and includes, but is not limited to, sub-optimal conditions associated with salinity, drought, temperature, metal, chemical, pathogenic and oxidative stresses, or combinations thereof. In preferred embodiments, the environmental stress can be salinity, drought, heat, or low temperature, or combinations thereof, and in particular, can be low water content or low temperature. Wherein drought stress means any environmental stress which leads to a lack of water in plants or reduction of water supply to plants, wherein low temperature stress means freezing of plants below +4° C. as well as chilling of plants below 15° C. and wherein high temperature stress means for example a temperature above 35° C. The range of stress and stress response depends on the different plants which are used for the invention, i.e. it differs for example between a plant such as wheat and a plant such as *Arabidopsis*. A common response of plants to environmental stress is the loss of yield or the loss of quality. It is also to be understood that as used in the specification and in the claims, "a" or "an" can mean one or more, depending upon the context in which it is used. Thus, for example, reference to "a cell" can mean that at least one cell can be utilized.

As also used herein, the terms "nucleic acid" and "nucleic acid molecule" are intended to include DNA molecules (e.g., cDNA or genomic DNA) and RNA molecules (e.g., mRNA) and analogs of the DNA or RNA generated using nucleotide analogs. This term also encompasses untranslated sequence located at both the 3' and 5' ends of the coding region of the gene: at least about 1000 nucleotides of sequence upstream from the 5' end of the coding region and at least about 200 nucleotides of sequence downstream from the 3' end of the coding region of the gene. The nucleic acid molecule can be single-stranded or double-stranded, but preferably is double-stranded DNA.

An "isolated" nucleic acid molecule is one that is substantially separated from other nucleic acid molecules, which are present in the natural source of the nucleic acid. That means other nucleic add molecules are present in an amount less than 5% based on weight of the amount of the desired nucleic acid, preferably less than 2% by weight, more preferably less than 1% by weight, most preferably less than 0.5% by weight. Preferably, an "isolated" nucleic acid is free of some of the sequences that naturally flank the nucleic acid (i.e., sequences located at the 5' and 3' ends of the nucleic acid) in the genomic DNA of the organism from which the nucleic acid is derived. For example, in various embodiments, the isolated stress related protein encoding nucleic acid molecule can contain less than about 5 kb, 4 kb, 3 kb, 2 kb, 1 kb, 0.5 kb or 0.1 kb of nucleotide sequences which naturally flank the nucleic acid molecule in genomic DNA of the cell from which the nucleic acid is derived. Moreover, an "isolated" nucleic acid molecule, such as a cDNA molecule, can be free from some of the other cellular material with which it is naturally associated, or culture medium when produced by recombinant techniques, or chemical precursors or other chemicals when chemically synthesized.

A nucleic acid molecule of the present invention, e.g., a nucleic acid molecule encoding an SRP or a portion thereof which confers tolerance and/or resistance to environmental stress in plants, can be isolated using standard molecular biological techniques and the sequence information provided herein. For example, a *Arabidopsis thaliana* stress related protein encoding cDNA can be isolated from a *A. thaliana* c-DNA library or a *Brassica napus, Glycine max, Zea mays* or *Oryza sativa* stress related protein encoding cDNA can be isolated from a *Brassica napus, Glycine max, Zea mays* or *Oryza sativa* respectively c-DNA library using all or portion of one of the sequences of SEQ ID NO: (4n+1) for n=0 to 54 and (2n+1) for n=110 to 487 and respectively. Moreover, a nucleic acid molecule encompassing all or a portion of one of the sequences of SEQ ID NO: (4n+1) for n=0 to 54 and (2n+1) for n=110 to 487 can be isolated by the polymerase chain reaction using oligonucleotide primers designed based upon this sequence. For example, mRNA can be isolated from plant cells (e.g., by the guanidinium-thiocyanate extraction procedure of Chirgwin et al., 1979 Biochemistry 18:5294-5299) and cDNA can be prepared using reverse transcriptase (e.g., Moloney MLV reverse transcriptase, available from Gibco/ BRL, Bethesda, Md.; or AMV reverse transcriptase, available from Seikagaku America, Inc., St. Petersburg, Fla.). Synthetic oligonucleotide primers for polymerase chain reaction amplification can be designed based upon one of the nucleotide sequences shown in SEQ ID NO: (4n+1) for n=0 to 54 and (2n+1) for n=110 to 487. A nucleic acid molecule of the invention can be amplified using cDNA or, alternatively, genomic DNA, as a template and appropriate oligonucleotide primers according to standard PCR amplification techniques. The nucleic acid molecule so amplified can be cloned into an appropriate vector and characterized by DNA sequence analysis. Furthermore, oligonucleotides corresponding to a SRP encoding nucleotide sequence can be prepared by standard synthetic techniques, e.g., using an automated DNA synthesizer.

In a preferred embodiment, an isolated nucleic acid molecule of the invention comprises one of the nucleotide sequences shown in sequences SEQ ID NO: (4n+1) for n=0 to 54 and (2n+1) for n=110 to 487 encoding the SRP (i.e., the "coding region"), as well as 5' untranslated sequences and 3' untranslated sequences.

Moreover, the nucleic acid molecule of the invention can comprise only a portion of the coding region of one of the sequences of the nucleic acid of SEQ ID NO: (4n+1) for n=0 to 54 and (2n+1) for n=110 to 487, for example, a fragment which can be used as a probe or primer or a fragment encoding a biologically active portion of a SRP.

Portions of proteins encoded by the SRP encoding nucleic acid molecules of the invention are preferably biologically active portions described herein. As used herein, the term "biologically active portion of" a SRP is intended to include a portion, e.g., a domain/motif, of stress related protein that participates in a stress tolerance and/or resistance response in a plant. To determine whether a SRP, or a biologically active portion thereof, results in increased stress tolerance in a plant, a stress analysis of a plant comprising the SRP may be performed. Such analysis methods are well known to those skilled in the art, as detailed in the Examples. More specifically, nucleic acid fragments encoding biologically active portions of a SRP can be prepared by isolating a portion of one of the sequences of the nucleic acid of SEQ ID NO: (4n+1) for n=0 to 54 and (2n+1) for n=110 to 487 expressing the encoded portion of the SRP or peptide (e.g., by recombinant expression in vitro) and assessing the activity of the encoded portion of the SRP or peptide.

Biologically active portions of a SRP are encompassed by the present invention and include peptides comprising amino acid sequences derived from the amino acid sequence of a SRP encoding gene, or the amino acid sequence of a protein homologous to a SRP, which include fewer amino acids than a full length SRP or the full length protein which is homologous to a SRP, and exhibits at least some enzymatic activity of a SRP. Typically, biologically active portions (e.g., peptides which are, for example, 5, 10, 15, 20, 30, 35, 36, 37, 38, 39, 40, 50, 100 or more amino acids in length) comprise a domain or motif with at least one activity of a SRP. Moreover, other biologically active portions in which other regions of the protein are deleted, can be prepared by recombinant techniques and evaluated for one or more of the activities described herein. Preferably, the biologically active portions of a SRP include one or more selected domains/motifs or portions thereof having biological activity.

The term "biological active portion" or "biological activity" means a SRP or a portion of a SRP which still has at least 10% or 20%, preferably 20%, 30%, 40% or 50%, especially preferably 60%, 70% or 80% of the enzymatic activity of the natural or starting enzyme.

A nucleic acid molecule encompassing a complete sequence of the nucleic acid molecules used in the process, for example the polynucleotide of the invention, or a part thereof may additionally be isolated by polymerase chain reaction, oligonucleotide primers based on this sequence or on parts thereof being used. For example, a nucleic acid molecule comprising the complete sequence or part thereof can be isolated by polymerase chain reaction using oligonucleotide primers which have been generated on the basis of this sequence—For example, mRNA can be isolated from cells (for example by means of the guanidinium thiocyanate extraction method of Chirgwin et al. (1979) Biochemistry 18:5294-5299) and cDNA can be generated by means of reverse transcriptase (for example Moloney MLV reverse transcriptase, available from Gibco/BRL, Bethesda, Md., or AMV reverse transcriptase, obtainable from Seikagaku America, Inc., St. Petersburg, Fla.).

Synthetic oligonucleotide primers for the amplification, e.g. as shown in table 2, by means of polymerase chain reaction can be generated on the basis of a sequence shown herein, for example the sequence shown in SEQ ID NO: (4n+1) for n=0 to 54 and (2n+1) for n=110 to 487 or the sequences derived from polypeptides as shown in SEQ ID NO: (4n+2) for n=0 to 54 and (2n+2) for n=110 to 487.

Moreover, it is possible to identify conserved regions from various organisms by carrying out protein sequence alignments with the polypeptide used in the process of the invention, in particular with sequences of the polypeptide of the invention, from which conserved regions, and in turn, degenerate primers can be derived. Conserved region for the polypeptide of the invention are indicated in the alignment shown in the figure ALIGNMENT. Conserved regions are those, which show a very little variation in the amino acid in one particular position of several homologs from different origin. The consensus sequences shown in FIG. 2 are derived from said alignments.

Degenerated primers can then be utilized by PCR for the amplification of fragments of novel proteins having above-mentioned activity, e.g. having an SPR activity or further functional homologs of the polypeptide of the invention from other organisms.

These fragments can then be utilized as hybridization probe for isolating the complete gene sequence. As an alternative, the missing 5' and 3' sequences can be isolated by means of RACE-PCR (rapid amplification of cDNA ends). A nucleic acid molecule according to the invention can be amplified using cDNA or, as an alternative, genomic DNA as template and suitable oligonucleotide primers, following standard PCR amplification techniques. The nucleic acid molecule amplified thus can be cloned into a suitable vector and characterized by means of DNA sequence analysis. Oligonucleotides, which correspond to one of the nucleic acid molecules used in the process can be generated by standard synthesis methods, for example using an automatic DNA synthesizer.

Nucleic acid molecules which are advantageously for the process according to the invention can be isolated based on their homology to the nucleic acid molecules disclosed herein using the sequences or part thereof as hybridization probe and following standard hybridization techniques under stringent hybridization conditions. In this context, it is possible to use, for example, isolated nucleic acid molecules of at least 15, 20, 25, 30, 35, 40, 50, 60 or more nucleotides, preferably of at least 15, 20 or 25 nucleotides in length which hybridize under stringent conditions with the above-described nucleic acid molecules, in particular with those which encompass a nucleotide sequence of the nucleic acid molecule used in the process of the invention or encoding a protein used in the invention or of the nucleic acid molecule of the invention. Nucleic acid molecules with 30, 50, 100, 250 or more nucleotides may also be used.

In addition to fragments of the SRP described herein, the present invention includes homologs and analogs of naturally occurring SRP and SRP encoding nucleic acids in a plant.

"Homologs" are defined herein as two nucleic acids or proteins that have similar, or "homologous", nucleotide or amino acid sequences, respectively. Homologs include allelic variants, orthologs, paralogs, agonists and antagonists of SRP as defined hereafter. The term "homolog" further encompasses nucleic acid molecules that differ from one of the nucleotide sequences shown in sequences with SEQ ID NO: (4n+1) for n=0 to 54 and (2n+1) for n=110 to 487 (and portions thereof) due to degeneracy of the genetic code and thus encode the same SRP as that encoded by the amino acid sequences shown in sequences with SEQ ID NO: (4n+2) for n=0 to 54 and (2n+2) for n=110 to 487. As used herein a "naturally occurring" SRP refers to a SRP amino acid sequence that occurs in nature.

The term "homology" means that the respective nucleic acid molecules or encoded proteins are functionally and/or structurally equivalent. The nucleic acid molecules that are homologous to the nucleic acid molecules described above and that are derivatives of said nucleic acid molecules are, for example, variations of said nucleic acid molecules which represent modifications having the same biological function, in particular encoding proteins with the same or substantially the same biological function. They may be naturally occurring variations, such as sequences from other plant varieties or species, or mutations. These mutations may occur naturally or may be obtained by mutagenesis techniques. The allelic variations may be naturally occurring allelic variants as well as synthetically produced or genetically engineered variants. Structurally equivalents can, for example, be identified by testing the binding of said polypeptide to antibodies or computer based predictions. Structurally equivalent have the similar immunological characteristic, e.g. comprise similar epitopes.

Functional equivalents derived from one of the polypeptides as shown in SEQ ID NO: (4n+2) for n=0 to 54 and (2n+2) for n=110 to 487 according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in SEQ ID NO: (4n+2) for n=0 to 54 and (2n+2) for n=110 to 487 according to the invention and are distinguished by essentially the same properties as the polypeptide as shown in SEQ ID NO: (4n+2) for n=0 to 54 and (2n+2) for n=110 to 487.

Functional equivalents derived from the nucleic acid sequence as shown in SEQ ID NO: (4n+2) for n=0 to 54 and (2n+2) for n=110 to 487 according to the invention by substitution, insertion or deletion have at least 30%, 35%, 40%, 45% or 50%, preferably at least 55%, 60%, 65% or 70% by preference at least 80%, especially preferably at least 85% or 90%, 91%, 92%, 93% or 94%, very especially preferably at least 95%, 97%, 98% or 99% homology with one of the polypeptides as shown in SEQ ID NO: (4n+2) for n=0 to 54 and (2n+2) for n=110 to 487 according to the invention and encode polypeptides having essentially the same properties as the polypeptide as shown in SEQ ID NO: (4n+2) for n=0 to 54 and (2n+2) for n=110 to 487.

"Essentially the same properties" of a functional equivalent is above all understood as meaning that the functional equivalent has above mentioned activity, e.g conferring an increase in the fine chemical amount white increasing the amount of protein, activity or function of said functional equivalent in an organism, e.g. a microorganism, a plant or plant or animal tissue, plant or animal cells or apart of the same.

By "hybridizing" it is meant that such nucleic acid molecules hybridize under conventional hybridization conditions, preferably under stringent conditions such as described by, e.g., Sambrook (Molecular Cloning; A Laboratory Manual, 2nd Edition, Cold Spring Harbor Laboratory Press, Cold Spring Harbor, N.Y. (1989)) or in Current Protocols in Molecular Biology, John Wiley & Sons, N.Y. (1989), 6.3.1-6.3.6.

According to the invention, DNA as well as RNA molecules of the nucleic acid of the invention can be used as probes. Further, as template for the identification of functional homologues Northern blot assays as well as Southern blot assays can be performed. The Northern blot assay advantageously provides further informations about the expressed gene product: e.g. expression pattern, occurance of processing steps, like splicing and capping, etc. The Southern blot assay provides additional information about the chromosomal localization and organization of the gene encoding the nucleic acid molecule of the invention.

A preferred, nonlimiting example of stringent hydridization conditions are hybridizations in 6× sodium chloride/sodium citrate (=SSC) at approximately 45° C., followed by one or more wash steps in 0.2×SSC, 0.1% SDS at 50 to 65° C., for example at 50° C., 55° C. or 60° C. The skilled worker knows that these hybridization conditions differ as a function of the type of the nucleic acid and, for example when organic solvents are present, with regard to the temperature and concentration of the buffer. The temperature under "standard hybridization conditions" differs for example as a function of the type of the nucleic acid between 42° C. and 58° C., preferably between 45° C. and 50° C. in an aqueous buffer with a concentration of 0.1×0.5×, 1×, 2×, 3×, 4× or 5×. SSC (pH 7.2). If organic solvent(s) is/are present in the abovementioned buffer, for example 50% formamide, the temperature under standard conditions is approximately 40° C., 42° C. or 45° C. The hybridization conditions for DNA:DNA hybrids are preferably for example 0.1×SSC and 20° C., 25° C., 30° C., 35° C., 40° C. or 45° C., preferably between 30° C. and 45° C. The hybridization conditions for DNA:RNA hybrids are preferably for example 0.1×SSC and 30° C., 35° C., 40° C., 45° C., 50° C. or 55° C., preferably between 45° C. and 55° C. The abovementioned hybridization temperatures are determined for example for a nucleic acid approximately 100 bp (=base pairs) in length and a G C content of 50% in the absence of formamide. The skilled worker knows to determine the hybridization conditions required with the aid of textbooks, for example the ones mentioned above, or from the following textbooks: Sambrook et al., "Molecular Cloning", Cold Spring Harbor Laboratory, 1989; Hames and Higgins (Ed.) 1985, "Nucleic Acids Hybridization: A Practical Approach", IRL Press at Oxford University Press, Oxford; Brown (Ed.) 1991, "Essential Molecular Biology: A Practical Approach", IRL Press at Oxford University Press, Oxford.

A further example of one such stringent hybridization condition is hybridization at 4×SSC at 65° C., followed by a washing in 0.1×SSC at 65° C. for one hour. Alternatively, an exemplary stringent hybridization condition is in 50% formamide, 4×SSC at 42° C. Further, the conditions during the wash step can be selected from the range of conditions delimited by low-stringency conditions (approximately 2×SSC at 50° C.) and high-stringency conditions (approximately 2×SSC at 50° C., preferably at 65° C.) (20×SSC: 0.3M sodium citrate, 3M NaCl, pH 7.0). In addition, the temperature during the wash step can be raised from low-stringency conditions at room temperature, approximately 22° C., to higher-stringency conditions at approximately 65° C. Both of the parameters salt concentration and temperature can be varied simultaneously, or else one of the two parameters can be kept constant while only the other is varied; Denaturants, for example formamide or SDS, may also be employed during the hybridization. In the presence of 50% formamide, hybridization is preferably effected at 42° C. Relevant factors like i) length of treatment, ii) salt conditions, iii) detergent conditions, iv) competitor DNAs, v) temperature and vi) probe selection can be combined case by case so that not all possibilities can be mentioned herein.

Thus, in a preferred embodiment, Northern blots are prehybridized with Rothi-Hybri-Quick buffer (Roth, Karlsruhe) at 68° C. for 2 h. Hybridization with radioactive labelled probe is done overnight at 68° C. Subsequent washing steps are performed at 68° C. with 1×SSC.

For Southern blot assays the membrane is prehybridized with Rothi-Hybri-Quick buffer (Roth, Karlsruhe) at 68° C. for 2 h. The hybridization with radioactive labelled probe is conducted over night at 68° C. Subsequently the hybridization buffer is discarded and the filter shortly washed using 2×SSC; 0.1% SDS. After discarding the washing buffer new 2×SSC; 0.1% SDS buffer is added and incubated at 68° C. for 15 minutes. This washing step is performed twice followed by an additional washing step using 1×SSC; 0.1% SDS at 68° C. for 10 min.

Polypeptides having above-mentioned activity, i.e. conferring the altered metabolic activity, derived from other organisms, can be encoded by other DNA sequences which hybridize to the sequences shown in SEQ ID NO: (4n+1) for n=0 to 54 and (2n+1) for n=110 to 487 under relaxed hybridization conditions and which code on expression for peptides conferring an altered metabolic activity.

Further, some applications have to be performed at low stringency hybridisation conditions, without any consequences for the specificity of the hybridisation. For example, a Southern blot analysis of total DNA could be probed with a nucleic acid molecule of the present invention and washed at low stringency (55° C. in 2×SSPE0.1% SDS). The hybridisation analysis could reveal a simple pattern of only genes encoding polypeptides of the present invention or used in the process of the invention, e.g. having herein-mentioned activity of increasing the fine chemical. A further example of such low-stringent hybridization conditions is 4×SSC at 50° C. or hybridization with 30 to 40% formamide at 42° C. Such molecules comprise those which are fragments, analogues or derivatives of the polypeptide of the invention or used in the process of the invention and differ, for example, by way of amino acid and/or nucleotide deletion(s), insertion(s), substitution (s), addition(s) and/or recombination (s) or any other modification(s) known in the art either alone or in combination from the above-described amino acid sequences or their underlying nucleotide sequence(s). However, it is preferred to use high stringency hybridisation conditions.

Hybridization should advantageously be carried out with fragments of at least 5, 10, 15, 20, 25, 30, 35 or 40 bp, advantageously at least 50, 60, 70 or 80 bp, preferably at least 90, 100 or 110 bp. Most preferably are fragments of at least 15, 20, 25 or 30 bp. Preferably are also hybridizations with at least 100 bp or 200, very especially preferably at least 400 bp in length. In an especially preferred embodiment, the hybridization should be carried out with the entire nucleic acid sequence with conditions described above.

The terms "fragment", "fragment of a sequence" or "part of a sequence" mean a truncated sequence of the original sequence referred to. The truncated sequence (nucleic acid or protein sequence) can vary widely in length; the minimum size being a sequence of sufficient size to provide a sequence with at least a comparable function and/or activity of the original sequence referred to or hybridizing with the nucleic acid molecule of the invention or used in the process of the invention under stringend conditions, while the maximum size is not critical. In some applications, the maximum size usually is not substantially greater than that required to provide the desired activity and/or function(s) of the original sequence.

In addition to fragments and fusion polypeptides of the SRPs described herein, the present invention includes homologs and analogs of naturally occurring SRPs and SRP encoding nucleic acids in a plant. "Homologs" are defined herein as two nucleic acids or polypeptides that have similar, or substantially identical, nucleotide or amino acid sequences, respectively. Homologs include allelic variants, orthologs, paralogs, agonists and antagonists of SRPs as defined hereafter. The term "homolog" further encompasses nucleic acid molecules that differ from one of the nucleotide sequences shown in SEQ ID NO: (4n+1) for n=0 to 54 and (2n+1) for n=110 to 487 (and portions thereof) due to degeneracy of the genetic code and thus encode the same SRP as that encoded by the nucleotide sequences shown in SEQ ID NO: (4n+1) for n=0 to 54 and (2n+1) for n=110 to 487. As used herein a "naturally occurring" SRP refers to a SRP amino acid sequence that occurs in nature. Preferably, a naturally occurring SRP comprises an amino acid sequence selected from the group consisting of polypeptides according SEQ ID NO: (4n+2) for n=0 to 54 and (2n+2) for n=110 to 487.

An agonist of the SRP can retain substantially the same, or a subset, of the biological activities of the SRP. An antagonist of the SRP can inhibit one or more of the activities of the naturally occurring form of the SRP. For example, the SRP antagonist can competitively bind to a downstream or upstream member of the cell membrane component metabolic cascade that includes the SRP, or bind to a SRP that mediates transport of compounds across such membranes, thereby preventing translocation from taking place.

Nucleic acid molecules corresponding to natural allelic variants and analogs, orthologs and paralogs of a SRP cDNA can be isolated based on their identity to the *Saccharomyces cerevisiae, E. coli* or based on their identity to the *Brassica napus, Glycine max, Zea mays* or *Oryza saliva* SRP nucleic acids described herein using SRP cDNAs, or a portion thereof, as a hybridization probe according to standard hybridization techniques under stringent hybridization conditions. In an alternative embodiment, homologs of the SRP can be identified by screening combinatorial libraries of mutants, e.g., truncation mutants, of the SRP for SRP agonist or antagonist activity. In one embodiment, a variegated library of SRP variants is generated by combinatorial mutagenesis at the nucleic acid level and is encoded by a variegated gene library. A variegated library of SRP variants can be produced by, for example, enzymatically ligating a mixture of synthetic oligonucleotides into gene sequences such that a degenerate set of potential SRP sequences is expressible as individual polypeptides, or alternatively, as a set of larger fusion polypeptides (e.g., for phage display) containing the set of SRP sequences therein. There are a variety of methods that can be used to produce libraries of potential SRP homologs from a degenerate oligonucleotide sequence. Chemical synthesis of a degenerate gene sequence can be performed in an automatic DNA synthesizer, and the synthetic gene is then ligated into an appropriate expression vector. Use of a degenerate set of genes allows for the provision, in one mixture, of all of the sequences encoding the desired set of potential SRP sequences. Methods for synthesizing degenerate oligonucleotides are known in the art. See, e.g., Narang, S. A., 1983, Tetrahedron 39:3; Itakura et al., 1984, Annu. Rev. Biochem. 53:323; Itakura et al., 1984, Science 198:1056; Ike et al., 1983, Nucleic Acid Res. 11:477.

In addition, libraries of fragments of the SRP coding regions can be used to generate a variegated population of SRP fragments for screening and subsequent selection of homologs of a SRP. In one embodiment, a library of coding sequence fragments can be generated by treating a double stranded PCR fragment of a SRP coding sequence with a nuclease under conditions wherein nicking occurs only about once per molecule, denaturing the double stranded DNA, renaturing the DNA to form double stranded DNA, which can include sense/antisense pairs from different nicked products, removing single stranded portions from reformed duplexes by treatment with S1 nuclease, and ligating the resulting fragment library into an expression vector. By this method, an expression library can be derived which encodes N-terminal, C-terminal, and internal fragments of various sizes of the SRP.

Several techniques are known in the art for screening gene products of combinatorial libraries made by point mutations or truncation, and for screening cDNA libraries for gene products having a selected property. Such techniques are adaptable for rapid screening of the gene libraries generated by the combinatorial mutagenesis of SRP homologs. The most widely used techniques, which are amenable to high through-put analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a new technique that enhances the frequency of functional mutants in the libraries, can be used in combination with the screening assays to identify SRP homologs (Arkin and Yourvan, 1992, PNAS 89:7811-7815; Delgrave et al., 1993, Polypeptide Engineering 6(3):327-331). In another embodiment, cell based assays can be exploited to analyze a variegated SRP library, using methods well known in the art. The present invention further provides a method of identifying a novel SRP, comprising (a) raising a specific antibody response to a SRP, or a fragment thereof, as described herein; (b) screening putative SRP material with the antibody, wherein specific binding of the antibody to the material indicates the presence of a potentially novel SRP; and (c) analyzing the bound material in comparison to known SRP, to determine its novelty.

As stated above, the present invention includes SRPs and homologs thereof. To determine the percent sequence identity of two amino acid sequences (e.g., one of the sequences according SEQ ID NO: (4n+2) for n=0 to 54 and (2n+2) for n=110 to 487, and a mutant form thereof), the sequences are aligned for optimal comparison purposes (e.g., gaps can be introduced in the sequence of one polypeptide for optimal alignment with the other polypeptide or nucleic acid). The amino acid residues at corresponding amino acid positions are then compared. When a position in one sequence (e.g., one of the sequences SEQ ID NO: (4n+2) for n=0 to 54 and (2n+2) for n=110 to 487) is occupied by the same amino acid residue as the corresponding position in the other sequence (e.g., a mutant form of the sequence selected from the polypeptide of according SEQ ID NO: (4n+2) for n=0 to 54 and (2n+2) for n=110 to 487), then the molecules are identical at that position. The same type of comparison can be made between two nucleic acid sequences.

The percent sequence identity between the two sequences is a function of the number of identical positions shared by the sequences (i.e., percent sequence identity=numbers of identical positions/total numbers of positions×100). Preferably, the isolated amino acid homologs included in the present invention are at least about 50-60%, preferably at least about 60-70%, and more preferably at least about 70-75%, 75-80%, 80-85%, 85-90% or 90-95%, and most preferably at least about 96%, 97%, 98%, 99% or more identical to an entire amino acid sequence according SEQ ID NO: (4n+2) for n=0 to 54 and (2n+2) for n=110 to 487. In yet another embodiment, the isolated amino acid homologs included in the present invention are at least about 50-60%, preferably at least about 60-70%, and more preferably at least about 70-75%, 75-80%, 80-85%, 85-90% or 90-95%, and most preferably at least about 96%, 97%, 98%, 99% or more identical to an entire amino acid sequence encoded by a nucleic acid sequence according SEQ ID NO: (4n+1) for n=0 to 54 and (2n+1) for n=110 to 487. In other embodiments, the SRP amino acid homologs have sequence identity over at least 15 contiguous amino acid residues, more preferably at least 25 contiguous amino acid residues, and most preferably at least 35 contiguous amino acid residues according SEQ ID NO: (4n+2) for n=0 to 54 and (2n+2) for n=110 to 487.

In another preferred embodiment, an isolated nucleic acid homolog of the invention comprises a nucleotide sequence which is at least about 50-60%, preferably at least about 60-70%, more preferably at least about 70-75%, 75-80%, 80-85%, 85-90% or 90-95%, and even more preferably at least about 95%, 96%, 97%, 98%, 99% or more identical to a nucleotide sequence according to SEQ ID NO: (4n+1) for n=0 to 54 and (2n+1) for n=110 to 487, or to a portion comprising at least 20, 30, 40, 50, 60 consecutive nucleotides thereof. The preferable length of sequence comparison for nucleic acids is at least 75 nucleotides, more preferably at least 100 nucleotides and most preferably the entire length of the coding region.

It is further preferred that the isolated nucleic acid homolog of the invention encodes a SRP, or portion thereof, that is at least 85% identical to an amino acid sequence according to SEQ ID NO: (4n+2) for n=0 to 54 and (2n+2) for n=110 to 487 and that functions as a modulator of an environmental stress response in a plant. In a more preferred embodiment, overexpression of the nucleic acid homolog in a plant increases the tolerance of the plant to an environmental stress.

For the purposes of the invention, the percent sequence identity between two nucleic acid or polypeptide sequences is determined using the Vector NTI 6.0 (PC) software package (InforMax, 7600 Wisconsin Ave., Bethesda, Md. 20814). A gap opening penalty of 15 and a gap extension penalty of 6.66 are used for determining the percent identity of two nucleic acids. A gap opening penalty of 10 and a gap extension penalty of 0.1 are used for determining the percent identity of two polypeptides. All other parameters are set at the default settings. For purposes of a multiple alignment (Clustal W algorithm), the gap opening penalty is 10, and the gap extension penalty is 0.05 with blosum62 matrix. It is to be understood that for the purposes of determining sequence identity when comparing a DNA sequence to an RNA sequence, a thymidine nucleotide is equivalent to a uracil nucleotide.

In another aspect, the invention provides an isolated nucleic acid comprising a polynucleotide that hybridizes to the polynucleotide according to SEQ ID NO: (4n+1) for n=0 to 54 and (2n+1) for n=110 to 487 under stringent conditions. More particularly, an isolated nucleic acid molecule of the invention is at least 15 nucleotides in length and hybridizes under stringent conditions to the nucleic acid molecule comprising a nucleotide sequence according to SEQ ID NO: (4n+1) for n=0 to 54 and (2n+1) for n=110 to 487. In other embodiments, the nucleic acid is at least 30, 50, 100, 250 or more nucleotides in length. Preferably, an isolated nucleic acid homolog of the invention comprises a nucleotide sequence which hybridizes under highly stringent conditions to the nucleotide sequence according to SEQ ID NO: (4n+1) for n=0 to 54 and (2n+1) for n=110 to 487, and functions as a modulator of stress tolerance in a plant. In a further preferred embodiment, overexpression of the isolated nucleic acid homolog in a plant increases a plant's tolerance to an environmental stress.

As used herein with regard to hybridization for DNA to DNA blot, the term "stringent conditions" refers in one embodiment to hybridization overnight at 60° C. in 10× Denharts solution, 6×SSC, 0.5% SDS and 100 μg/ml denatured salmon sperm DNA. Blots are washed sequentially at 62° C. for 30 minutes each time in 3×SSC/0.1% SDS, followed by 1×SSC/0.1% SDS and finally 0.1×SSC/0.1% SDS. As also used herein, "highly stringent conditions" refers to hybridization overnight at 65° C. in 10× Denharts solution, 6×SSC, 0.5% SDS and 100 μg/ml denatured salmon sperm DNA. Blots are washed sequentially at 65° C. for 30 minutes each time in 3×SSC/0.1% SOS, followed by 1×SSC/0.1% SDS and finally 0.1×SSC/0.1% SDS. Methods for nucleic acid hybridizations are described in Meinkoth and Wahl, 1984, Anal. Biochem. 138:267-284; Ausubel et al. eds, 1995, Current Protocols in Molecular Biology, Chapter 2, Greene Publishing and Wiley-Interscience, New York; and Tijssen, 1993, Laboratory Techniques in Biochemistry and Molecular Biology: Hybridization with Nucleic Acid Probes, Part I, Chapter 2, Elsevier, N.Y. Preferably, an isolated nucleic acid molecule of the invention that hybridizes under stringent or highly stringent conditions to a sequence of SEQ ID NO: (4n+1) for n=0 to 54 and (2n+1) for n=110 to 487 corresponds to a naturally occurring nucleic acid molecule. As used herein, a "naturally occurring" nucleic acid molecule refers to an RNA or DNA molecule having a nucleotide sequence that occurs in nature (e.g., encodes a natural polypeptide). In one embodiment, the nucleic acid encodes a naturally occurring Saccharomyces cerevisiae, E. coli SRP or a naturally occurring Brassica napus, Glycine max, Zea mays or Oryza sativa SRP.

Using the above-described methods, and others known to those of skill in the art, one of ordinary skill in the art can isolate homologs of the SRPs comprising amino acid sequences shown in SEQ ID NO: (4n+2) for n=0 to 54 and (2n+2) for n=110 to 487. One subset of these homologs are allelic variants. As used herein, the term "allelic variant" refers to a nucleotide sequence containing polymorphisms that lead to changes in the amino acid sequences of a SRP and that exist within a natural population (e.g., a plant species or variety). Such natural allelic variations can typically result in 1-5% variance in a SRP nucleic acid. Allelic variants can be identified by sequencing the nucleic acid sequence of interest in a number of different plants, which can be readily carried out by using hybridization probes to identify the same SRP genetic locus in those plants. Any and all such nucleic acid variations and resulting amino acid polymorphisms or variations in a SRP that are the result of natural allelic variation and that do not alter the functional activity of a SRP, are intended to be within the scope of the invention.

An isolated nucleic acid molecule encoding a SRP having sequence identity with a polypeptide sequence of SEQ ID NO: (4n+2) for n=0 to 54 and (2n+2) for n=110 to 487 can be created by introducing one or more nucleotide substitutions, additions or deletions into a nucleotide sequence of SEQ ID NO: (4n+1) for n=0 to 54 and (2n+1) for n=110 to 487, respectively, such that one or more amino acid substitutions, additions, or deletions are introduced into the encoded polypeptide. Mutations can be introduced into one of the sequences of SEQ ID NO: (4n+1) for n=0 to 54 and (2n+1) for n=110 to 487 by standard techniques, such as site-directed mutagenesis and PCR-mediated mutagenesis. Preferably, conservative amino acid substitutions are made at one or more predicted non-essential amino acid residues. A "conservative amino acid substitution" is one in which the amino acid residue is replaced with an amino acid residue having a similar side chain.

Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, a predicted nonessential amino acid residue in a SRP is preferably replaced with another amino acid residue from the same side chain family. Alternatively, in another embodiment, mutations can be introduced randomly along all or part of a SRP coding sequence, such as by saturation mutagenesis, and the resultant mutants can be screened for a SRP activity described herein to identify mutants that retain SRP activity. Following mutagenesis of one of the sequences of SEQ ID NO: (4n+1) for n=0 to 54 and (2n+1) for n=110 to 487, the encoded polypeptide can be expressed recombinantly and the activity of the polypeptide can be determined by analyzing the stress tolerance of a plant expressing the polypeptide as described herein.

Additionally, optimized SRP nucleic acids can be created. As used herein, "optimized" refers to a nucleic acid that is genetically engineered to increase its expression in a given plant or animal. To provide plant optimized SRP nucleic acids, the DNA sequence of the gene can be modified to 1) comprise codons preferred by highly expressed plant genes; 2) comprise an A+T content in nucleotide base composition to that substantially found in plants; 3) form a plant initiation sequence; or 4) eliminate sequences that cause destabilization, inappropriate polyadenylation, degradation, and termination of RNA, or that form secondary structure hairpins or RNA splice sites. Increased expression of SRP nucleic acids in plants can be achieved by utilizing the distribution frequency of codon usage in plants in general or a particular plant Methods for optimizing nucleic acid expression in plants can be found in EPA 0359472; EPA 0385962; PCT Application No. WO 91/16432; U.S. Pat. No. 5,380,831; U.S. Pat. No. 5,436,391; Perlack et al., 1991, Proc. Natl. Acad. Sci. USA 88:3324-3328; and Murray et al., 1989, Nucleic Acids Res. 17:477-498.

As used herein, "frequency of preferred codon usage" refers to the preference exhibited by a specific host cell in usage of nucleotide codons to specify a given amino acid. To determine the frequency of usage of a particular codon in a gene, the number of occurrences of that codon in the gene is divided by the total number of occurrences of all codons specifying the same amino acid in the gene. Similarly, the frequency of preferred codon usage exhibited by a host cell can be calculated by averaging frequency of preferred codon usage in a large number of genes expressed by the host cell. It is preferable that this analysis be limited to genes that are highly expressed by the host cell. The percent deviation of the frequency of preferred codon usage for a synthetic gene from that employed by a host cell is calculated first by determining the percent deviation of the frequency of usage of a single codon from that of the host cell followed by obtaining the average deviation over all codons. As defined herein, this calculation includes unique codons (i.e., ATG and TGG). In general terms, the overall average deviation of the codon usage of an optimized gene from that of a host cell is calculated using the equation 1A=n=1 Z $X_n$-$Y_n$ $X_n$ times 100 Z where $X_n$=frequency of usage for codon n in the host cell; $Y_n$=frequency of usage for codon n in the synthetic gene; n represents an individual codon that specifies an amino acid; and the total number of codons is Z. The overall deviation of the frequency of codon usage, A, for all amino acids should preferably be less than about 25%, and more preferably less than about 10%.

Hence, a SRP nucleic acid can be optimized such that its distribution frequency of codon usage deviates, preferably, no more than 25% from that of highly expressed plant genes and, more preferably, no more than about 10%. In addition, consideration is given to the percentage G+C content of the degenerate third base (monocotyledons appear to favor G+C in this position, whereas dicotyledons do not). It is also recognized that the XCG (where X is A, T, C, or G) nucleotide is the least preferred codon in divots whereas the XTA codon is avoided in both monocots and divots. Optimized SRP nucleic acids of this invention also preferably have CG and TA doublet avoidance indices closely approximating those of the chosen host plant. More preferably these indices deviate from that of the host by no more than about 10-15%.

In addition to the nucleic acid molecules encoding the SRPs described above, another aspect of the invention pertains to isolated nucleic acid molecules that are antisense thereto. Antisense polynucleotides are thought to inhibit gene expression of a target polynucleotide by specifically binding the target polynucleotide and interfering with transcription, splicing, transport, translation, and/or stability of the target polynucleotide. Methods are described in the prior art for targeting the antisense polynucleotide to the chromosomal DNA, to a primary RNA transcript, or to a processed mRNA. Preferably, the target regions include splice sites, translation initiation codons, translation termination codons, and other sequences within the open reading frame.

The term "antisense," for the purposes of the invention, refers to a nucleic acid comprising a polynucleotide that is sufficiently complementary to all or a portion of a gene, primary transcript, or processed mRNA, so as to interfere with expression of the endogenous gene. "Complementary" polynucleotides are those that are capable of base pairing according to the standard Watson-Crick complementarity rules. Specifically, purines will base pair with pyrimidines to form a combination of guanine paired with cytosine (G:C) and adenine paired with either thymine (A:T) in the case of DNA, or adenine paired with uracil (A:U) in the case of RNA. It is understood that two polynucleotides may hybridize to each other even if they are not completely complementary to each other, provided that each has at least one region that is substantially complementary to the other. The term "antisense nucleic acid" includes single stranded RNA as well as double-stranded DNA expression cassettes that can be transcribed to produce an antisense RNA. "Active" antisense nucleic acids are antisense RNA molecules that are capable of selectively hybridizing with a primary transcript or mRNA encoding a polypeptide having at least 80% sequence identity with the polypeptide of SEQ ID NO: (4n+2) for n=0 to 54 and (2n+2) for n=110 to 487.

The antisense nucleic acid can be complementary to an entire SRP coding strand, or to only a portion thereof. In one embodiment, an antisense nucleic acid molecule is antisense to a "coding region" of the coding strand of a nucleotide sequence encoding a SRP. The term "coding region" refers to the region of the nucleotide sequence comprising codons that are translated into amino acid residues. In another embodiment, the antisense nucleic acid molecule is antisense to a "noncoding region" of the coding strand of a nucleotide sequence encoding a SRP. The term "noncoding region" refers to 5' and 3' sequences that flank the coding region that are not translated into amino acids (i.e., also referred to as 5' and 3' untranslated regions). The antisense nucleic acid molecule can be complementary to the entire coding region of SRP mRNA, but more preferably is an oligonucleotide which is antisense to only a portion of the coding or noncoding region of SRP mRNA. For example, the antisense oligonucleotide can be complementary to the region surrounding the translation start site of PKSRP mRNA. An antisense oligonucleotide can be, for example, about 5, 10, 15, 20, 25, 30, 35, 40, 45 or 50 nucleotides in length. Typically, the antisense molecules of the present invention comprise an RNA having 60-100% sequence identity with at least 14 consecutive nucleotides of one of the nucleic acid of SEQ ID NO: (4n+1) for n=0 to 54 and (2n+1) for n=110 to 487. Preferably, the sequence identity will be at least 70%, more preferably at least 75%, 80%, 85%, 90%, 95%, 98% and most preferably 99%.

An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N-6-isopentenyladenine, uracil-5-oxyacetic acid (v), wybutoxosine; pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N2-carboxypropyl) uracil, (acp3)w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

In yet another embodiment, the antisense nucleic acid molecule of the invention is an α-anomeric nucleic acid molecule. An α-anomeric nucleic acid molecule forms specific double-stranded hybrids with complementary RNA in which, contrary to the usual β-units, the strands run parallel to each other (Gaultier et al., 1987, Nucleic Acids. Res. 15:6625-6641). The antisense nucleic acid molecule can also comprise a 2'-o-methylribonucleotide (Inoue et al., 1987, Nucleic Acids Res. 15:6131-6148) or a chimeric RNA-DNA analogue (Inoue et al., 1987, FEBS Lett. 215:327-330).

The antisense nucleic acid molecules of the invention are typically administered to a cell or generated in situ such that they hybridize with or bind to cellular mRNA and/or genomic DNA encoding a SRP to thereby inhibit expression of the polypeptide, e.g., by inhibiting transcription and/or translation. The hybridization can be by conventional nucleotide complementarity to form a stable duplex, or, for example, in the case of an antisense nucleic acid molecule which binds to DNA duplexes, through specific interactions in the major groove of the double helix. The antisense molecule can be modified such that it specifically binds to a receptor or an antigen expressed on a selected cell surface, e.g., by linking the antisense nucleic acid molecule to a peptide or an antibody which binds to a cell surface receptor or antigen. The antisense nucleic acid molecule can also be delivered to cells using the vectors described herein. To achieve sufficient intracellular concentrations of the antisense molecules, vector constructs in which the antisense nucleic acid molecule is placed under the control of a strong prokaryotic, viral, or eukaryotic (including plant) promoter are preferred.

As an alternative to antisense polynucleotides, ribozymes, sense polynucleotides, or double stranded RNA (dsRNA) can be used to reduce expression of a SRP polypeptide. By "ribozyme" is meant a catalytic RNA-based enzyme with ribonuclease activity which is capable of cleaving a single-stranded nucleic acid, such as an mRNA, to which it has a complementary region. Ribozymes (e.g., hammerhead ribozymes described in Haselhoff and Gerlach, 1988, Nature 334:585-591) can be used to catalytically cleave SRP mRNA transcripts to thereby inhibit translation of SRP mRNA. A ribozyme having specificity for a SRP-encoding nucleic acid can be designed based upon the nucleotide sequence of a SRP cDNA, as disclosed herein (i.e. SEQ ID NO: (4n+1) for n=0 to 54 and (2n+1) for n=110 to 487) or on the basis of a heterologous sequence to be isolated according to methods taught in this invention. For example, a derivative of a Tetrahymena L-19 IVS RNA can be constructed in which the nucleotide sequence of the active site is complementary to the nucleotide sequence to be cleaved in a SRP-encoding mRNA. See, e.g., U.S. Pat. Nos. 4,987,071 and 5,116,742 to Cech et al. Alternatively, SRP mRNA can be used to select a catalytic RNA having a specific ribonuclease activity from a pool of RNA molecules. See, e.g., Bartel, D. and Szostak, J. W., 1993, Science 261:1411-1418. In preferred embodiments, the ribozyme will contain a portion having at least 7, 8, 9, 10, 12, 14, 16, 18 or 20 nucleotides, and more preferably 7 or 8 nucleotides, that have 100% complementarity to a portion of the target RNA. Methods for making ribozymes are known to those skilled in the art. See, e.g., U.S. Pat. Nos. 6,025,167; 5,773,260; and 5,496,698.

The term "dsRNA," as used herein, refers to RNA hybrids comprising two strands of RNA. The dsRNAs can be linear or circular in structure. In a preferred embodiment, dsRNA is specific for a polynucleotide encoding either the polypeptide according to SEQ ID NO: (4n+2) for n=0 to 54 and (2n+2) for n=110 to 487 or a polypeptide having at least 70% sequence identity with a polypeptide according to SEQ ID NO: (4n+2) for n=0 to 54 and (2n+2) for n=110 to 487. The hybridizing RNAs may be substantially or completely complementary. By "substantially complementary," is meant that when the two hybridizing RNAs are optimally aligned using the BLAST program as described above, the hybridizing portions are at least 95% complementary. Preferably, the dsRNA will be at least 100 base pairs in length. Typically, the hybridizing RNAs will be of identical length with no over hanging 5' or 3' ends and no gaps. However, dsRNAs having 5' or 3' overhangs of up to 100 nucleotides may be used in the methods of the invention.

The dsRNA may comprise ribonucleotides or ribonucleotide analogs, such as 2'-O-methyl ribosyl residues, or combinations thereof. See, e.g., U.S. Pat. Nos. 4,130,641 and 4,024,222. A dsRNA polyriboinosinic acid:polyribocytidylic acid is described in U.S. Pat. No. 4,283,393. Methods for making and using dsRNA are known in the art. One method comprises the simultaneous transcription of two complementary DNA strands, either in vivo, or in a single in vitro reaction mixture. See, e.g., U.S. Pat. No. 5,795,715. In one embodiment, dsRNA can be introduced into a plant or plant cell directly by standard transformation procedures. Alternatively, dsRNA can be expressed in a plant cell by transcribing two complementary RNAs.

Other methods for the inhibition of endogenous gene expression, such as triple helix formation (Moser et al., 1987, Science 238:645-650 and Cooney et al., 1988, Science 241:456-459) and cosuppression (Napoli et al., 1990, The Plant Cell 2:279-289) are known in the art. Partial and full-length cDNAs have been used for the cosuppression of endogenous plant genes. See, e.g., U.S. Pat. Nos. 4,801,340, 5,034,323, 5,231,020, and 5,283,184; Van der Kroll et al., 1990, The Plant Cell 2:291-299; Smith et al., 1990, Mol. Gen. Genetics 224:477-481 and Napoli et al., 1990, The Plant Cell 2:279-289.

For sense suppression, it is believed that introduction of a sense polynucleotide blocks transcription of the corresponding target gene. The sense polynucleotide will have at least 65% sequence identity with the target plant gene or RNA. Preferably, the percent identity is at least 80%, 90%, 95% or more. The introduced sense polynucleotide need not be full length relative to the target gene or transcript. Preferably, the sense polynucleotide will have at least 65% sequence identity with at least 100 consecutive nucleotides of one of the nucleic acids of SEQ ID NO: (4n+1) for n=0 to 54 and (2n+1) for n=110 to 487. The regions of identity can comprise introns and/or exons and untranslated regions. The introduced sense polynucleotide may be present in the plant cell transiently, or may be stably integrated into a plant chromosome or extra-chromosomal replicon.

Moreover, nucleic acid molecules encoding SRP from the same or other species such as SRP analogs, orthologs and paralogs, are intended to be within the scope of the present invention. As used herein, the term "analogs" refers to two nucleic acids that have the same or similar function, but that have evolved separately in unrelated organisms. As used herein, the term "orthologs" refers to two nucleic acids from different species that have evolved from a common ancestral gene by speciation. Normally, orthologs encode proteins having the same or similar functions. As also used herein, the term "paralogs" refers to two nucleic acids that are related by duplication within a genome. Paralogs usually have different functions, but these functions may be related (Tatusov, R. L. et al. 1997 Science 278(5338):631-637). Analogs, orthologs and paralogs of a naturally occurring stress related protein can differ from the naturally occurring stress related protein by post-translational modifications, by amino acid sequence differences, or by both. Post-translational modifications include in vivo and in vitro chemical derivatization of polypeptides e.g., acetylation, carboxylation, phosphorylation or glycosylation, and such modifications may occur during polypeptide synthesis or processing or following treatment with isolated modifying enzymes. In particular, orthologs of the invention will generally exhibit at least 80-85%, more preferably 90%, 91%, 92%, 93%, 94%, and most preferably 95%, 96%, 97%, 98% or even 99% identity or homology with all or part of a naturally occurring stress related protein amino acid sequence and will exhibit a function similar to a stress related protein. Orthologs of the present invention are also preferably capable of participating in the stress response in plants.

In addition to naturally-occurring variants of a stress related protein sequence that may exist in the population, the skilled artisan will further appreciate that changes can be introduced by mutation into a nucleotide sequence SEQ ID NO: (4n+1) for n=0 to 54 and (2n+1) for n=110 to 487, thereby leading to changes in the amino acid sequence of the encoded stress related protein, without altering the functional ability of the stress related protein or enhancing the functional ability of the stress related protein. For example, nucleotide substitutions leading to amino acid substitutions at "non-essential" amino acid residues can be made in a sequence of SEQ ID NO: (4n+2) for n=0 to 54 and (2n+2) for n=110 to 487. "non-essential" amino acid residue is a residue that can be altered from the wild-type sequence of one of stress related proteins without altering the activity thereof, whereas an "essential" amino acid residue is required for stress related protein activity. Other amino acid residues, however, (e.g., those that are not conserved or only semi-conserved in the domain having SRP activity) may not be essential for activity and thus are likely to be amenable to alteration without altering SRP activity.

Accordingly, another aspect of the invention pertains to nucleic acid molecules encoding stress related proteins that contain changes in amino acid residues that are not essential for stress related protein activity. Such SRP differ in amino acid sequence from a sequence of SEQ ID NO: (4n+2) for n=0 to 54 and (2n+2) for n=110 to 487, yet retain at least one of the stress related protein activities described herein. In one embodiment, the isolated nucleic acid molecule comprises a nucleotide sequence encoding a protein, wherein the protein comprises an amino acid sequence at least about 50% homologous to an amino acid sequence of SEQ ID NO: (4n+2) for n=0 to 54 and (2n+2) for n=110 to 487. Preferably, the protein encoded by the nucleic acid molecule is at least about 50-60% homologous to one of the sequences of the SEQ ID NO: (4n+1) for n=0 to 54 and (2n+1) for n=110 to 487, more preferably at least about 60-70% homologous to one of the sequences of SEQ ID NO: (4n+1) for n=0 to 54 and (2n+1) for n=110 to 487, even more preferably at least about 70-80%, 80-90%, more preferably 90%, 91%, 92%, 93%, 94% homologous to one of the sequences of SEQ ID NO: (4n+1) for n=0 to 54 and (2n+1) for n=110 to 487 and most preferably at least about 96%, 97%, 98%, or 99% homologous to one of the sequences of the SEQ ID NO: (4n+1) for n=0 to 54 and (2n+1) for n=110 to 487. The preferred stress related protein homologs of the present invention are preferably capable of participating in the stress tolerance response in a plant. The homology (=identity) was calculated over the entire amino acid range. The program used was PileUp (J. Mol. Evolution., 25 (1987), 351-360, Higgins et al., CABIOS, 5 1989: 151-153).

Homologs of the sequences given in SEQ ID NO: (4n+1) for n=0 to 54 and (2n+1) for n=110 to 487 are furthermore to be understood as meaning, for example, homologs, analogs, orthologs and paralogs which have at least 30% homology (=identity) at the derived amino acid level, preferably at least 50%, 60%, 70% or 80% homology, especially preferably at least 85% homology, very especially preferably 90% 91%, 92%, 93%, 94% homology, most preferably 95%, 96%, 97%, 98% or 99% homology. The homology (=identity) was calculated over the entire amino acid range. The program used was PileUp (J. Mol. Evolution., 25 (1987), 351-360, Higgens et al., CABIOS, 5 1989: 151-153) or the program Gap and BestFit [Needleman and Wunsch (J. Mol. Biol. 48; 443-453 (1970) and Smith and Waterman respectively (Adv. Appl. Math. 2; 482-489 (1981)] which are part of the GCG software package [Genetics Computer Group, 575 Science Drive, Madison, Wis., USA 53711 (1991)]. The above mentioned percentages of sequence homology are calculated with the program BestFit or Gap, preferably Gap, over the total sequence length with the following parameters used: Gap Weight: 8, Length Weight 2.

For the determination of the percentage homology (=identity) of two or more amino acids or of two or more nucleotide sequences several computer software programs have been developed. The homology of two or more sequences can be calculated with for example the software fasta, which presently has been used in the version fasta 3 (W. R. Pearson and D. J. Lipman (1988), Improved Tools for Biological Sequence Comparison. PNAS 85:2444-2448; W. R. Pearson (1990) Rapid and Sensitive Sequence Comparison with FASTP and FASTA, Methods in Enzymology 183:63-98; W. R. Pearson and D. J. Lipman (1988) Improved Tools for Biological Sequence Comparison. PNAS 85:2444-2448; W. R. Pearson (1990); Rapid and Sensitive Sequence Comparison with FASTP and FASTAMethods in Enzymology 183: 63-98). Another useful program for the calculation of homologies of different sequences is the standard blast program, which is included in the Biomax pedant software (Biomax, Munich, Federal Republic of Germany). This leads unfortunately sometimes to suboptimal results since blast does not always include complete sequences of the subject and the querry. Nevertheless as this program is very efficient it can be used for the comparison of a huge number of sequences. The following settings are typically used for such a comparisons of sequences:

-p Program Name [String]; -d Database [String]; default=nr; -i Query File [File In]; default=stdin; -e Expectation value (E) [Real]; default=10.0; -m alignment view options: 0=pairwise; 1=query-anchored showing identities; 2=query-anchored no identities; 3=flat query-anchored, show identities; 4=flat query-anchored, no identities; 5=query-anchored no identities and blunt ends; 6=flat query-anchored, no identities and blunt ends; 7=XML Blast output; 8=tabular; 9 tabular with comment lines [Integer]; default=0; -o BLAST report Output File [File Out] Optional; default=stdout; -F Filter query sequence (DUST with blastn, SEG with others) [String]; default=T; -G Cost to open a gap (zero invokes default behavior) [Integer]; default=0; -E Cost to extend a gap (zero invokes default behavior) [Integer]; default=0; -X X dropoff value for gapped alignment (in bits) (zero invokes default behavior); blastn 30, megablast 20, tblastx 0, all others 15 [Integer]; default=0; -I Show GI's in deflines [T/F]; default=F; -q Penalty for a nucleotide mismatch (blastn only) [Integer]; default=−3; -r Reward for a nucleotide match (blastn only) [Integer]; default=1; -v Number of database sequences to show one-line descriptions for (V) [Integer]; default=500; -b Number of database sequence to show alignments for (B) [Integer]; default=250; -f Threshold for extending hits, default if zero; blastp 11, blastn 0, blastx 12, tblastn 13; tblastx 13, megablast 0 [Integer]; default=0; -g Perform gapped alignment (not available with tblastx) [T/F]; default=T; -Q Query Genetic code to use [Integer]; default=1; -D DB Genetic code (for tblast[nx] only) [Integer]; default=1; -a Number of processors to use [Integer]; default=1; -O SeqAlign file [File Out] Optional; -J Believe the query defline [T/F]; default=F; -M Matrix [String]; default=BLOSUM62; -W Word size, default if zero (blastn 11, megablast 28, all others 3) [Integer]; default=0; -z Effective length of the database (use zero for the real size) [Real]; default=0; -K Number of best hits from a region to keep (off by default, if used a value of 100 is recommended) [Integer]; default=0; -P 0 for multiple hit, 1 for single hit [Integer]; default=0; -Y Effective length of the search space (use zero for the real size) [Real]; default=0; -S Query strands to search against database (for blast[nx], and tblastx); 3 is both, 1 is top, 2 is bottom [Integer]; default=3; -T Produce HTML output [T/F]; default=F; -I Restrict search of database to list of GI's [String] Optional; -U Use lower case filtering of FASTA sequence [T/F] Optional; default=F; -y X dropoff value for ungapped extensions in bits (0.0 invokes default behavior); blastn 20, megablast 10, all others 7 [Real]; default=0.0; -Z X dropoff value for final gapped alignment in bits (0.0 invokes default behavior); blastn/megablast 50, tblastx 0, all others 25 [Integer]; default=0; -R PSI-TBLASTN checkpoint file [File In] Optional; -n MegaBlast search [T/F]; default=F; -L Location on query, sequence [String] Optional; -A Multiple Hits window size, default if zero (blastn/megablast 0, all others 40 [Integer]; default=0; -w Frame shift penalty (OOF algorithm for blastx) [Integer]; default=0; -t Length of the largest intron allowed in tblastn for linking HSPs (0 disables linking) [Integer]; default=0.

Results of high quality are reached by using the algorithm of Needleman and Wunsch or Smith and Waterman. Therefore programs based on said algorithms are preferred. Advantageously the comparisons of sequences can be done with the program PileUp (J. Mol. Evolution., 25, 351-360, 1987, Higgins et al., CABIOS, 5 1989: 151-153) or preferably with the programs Gap and BestFit, which are respectively based on the algorithms of Needleman and Wunsch [J. Mol. Biol. 48; 443-453 (1970)] and Smith and Waterman [Adv. Appl. Math. 2; 482-489 (1981)]. Both programs are part of the GCG software-package [Genetics Computer Group, 575 Science Drive, Madison, Wis., USA 53711 (1991); Altschul et al. (1997) Nucleic Acids Res. 25:3389 et seq.]. Therefore preferably the calculations to determine the percentages of sequence homology are done with the program Gap over the whole range of the sequences. The following standard adjustments for the comparison of nucleic acid sequences were used: gap weight: 50, length weight: 3, average match: 10.000, average mismatch: 0.000.

For the comparison of amino acid sequences the same algorithms as described above or nucleic acid sequences can be used. Results of high quality are reached by using the algorithm of Needleman and Wunsch or Smith and Waterman. Therefore programs based on said algorithms are preferred. Advantageously the comparisons of sequences can be done with the program PileUp (J. Mol. Evolution., 25, 351-360, 1987, Higgins et al., CABIOS, 5 1989: 151-153) or preferably with the programs Gap and BestFit, which are respectively based on the algorithms of Needleman and Wunsch [J. Mol. Biol. 48; 443-453 (1970)] and Smith and Waterman [Adv. Appl. Math. 2; 482-489 (1981)]. Both programs are part of the GCG software-package [Genetics Computer Group, 575 Science Drive, Madison, Wis., USA 53711 (1991); Altschul et al. (1997) Nucleic Acids Res. 25:3389 et seq.]. Therefore preferably the calculations to determine the percentages of sequence homology are done with the program Gap over the whole range of the sequences. The following standard adjustments for the comparison of amino acid sequences were used: gap weight: 8, length weight: 2, average match: 2.912, average mismatch: −2.003.

Variants shall also be encompassed, in particular, functional variants which can be obtained from the sequence shown in the SEQ ID NO: (4n+1) for n=0 to 54 and (2n+1) for n=110 to 487 by means of deletion, insertion or substitution of nucleotides, the enzymatic activity of the derived synthetic proteins being retained or enhanced.

An isolated nucleic acid molecule encoding a stress related protein homologous to a protein sequence according to SEQ ID NO: (4n+2) for n=0 to 54 and (2n+2) for n=110 to 487 can be created by introducing one or more nucleotide substitutions, additions or deletions into a nucleotide sequence of SEQ ID NO: (4n+1) for n=0 to 54 and (2n+1) for n=110 to 487 such that one or more amino acid substitutions, additions or deletions are introduced into the encoded protein. Mutations can be introduced into one of the sequences of SEQ ID NO: (4n+1) for n=0 to 54 and (2n+1) for n=110 to 487 by standard techniques, such as site-directed mutagenesis and PCR-mediated mutagenesis. Another route to the mutagenesis of enzymes, disclosed in the European Publication EP-A-0 909 821, is a method using the specific *Escherichia coli* strain XL1-Red to generate mutants and altered the enzyme activity.

Preferably, conservative amino acid substitutions are made at one or more predicted non-essential amino acid residues. A "conservative amino acid substitution" is one in which the amino acid residue is replaced with an amino acid residue having a similar side chain.

Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, a predicted nonessential amino acid residue in a stress related protein is preferably replaced with another amino acid residue from the same side chain family. Alternatively, in another embodiment, mutations can be introduced randomly along all or part of a stress related protein coding sequence, such as by saturation mutagenesis, and the resultant mutants can be screened for a stress related protein activity as described herein to identify mutants that retain stress related protein activity or show enhanced stress related protein activity. Following mutagenesis of one of the sequences of the nucleic acid of SEQ ID NO: (4n+1) for n=0 to 54 and (2n+1) for n=110 to 487, the encoded protein can be expressed recombinantly and the activity of the protein can be determined by analyzing the stress tolerance of a plant expressing the protein as described in the examples below.

A useful method to ascertain the level of transcription of the gene (an indicator of the amount of mRNA available for translation to the gene product) is to perform a Northern blot (for reference see, for example, Ausubel et al., 1988 Current Protocols in Molecular Biology, Wiley: New York). This information at least partially demonstrates the degree of transcription of the gene. Total cellular RNA can be prepared from cells, tissues or organs by several methods, all well-known in the art, such as that described in Bormann, E. R. et al., 1992 Mol. Microbiol. 6:317-326. To assess the presence or relative quantity of protein translated from this mRNA, standard techniques, such as a Western blot, may be employed. These techniques are well known to one of ordinary skill in the art (see, for example, Ausubel et al., 1988 Current Protocols in Molecular Biology, Wiley: New York).

The present invention also relates to a plant expression cassette comprising a SRP coding nucleic acid selected from the group comprising sequences of SEQ ID NO: (4n+1) for n=0 to 54 and (2n+1) for n=110 to 487 and/or homologs or parts thereof operatively linked to regulatory sequences and/or targeting sequences.

Further, object of the invention is an expression vector comprising a SRP encoding nucleic acid selected from the group comprising sequences of the nucleic acid of SEQ ID NO: (4n+1) for n=0 to 54 and (2n+1) for n=110 to 487 and/or homologs or parts thereof or a plant expression cassette as described above, whereby expression of the SRP coding nucleic acid in a host cell results in increased tolerance to environmental stress as compared to a corresponding non-transformed wild type host cell.

The invention further provides an isolated recombinant expression vector comprising a stress related protein encoding nucleic acid as described above, wherein expression of the vector or stress related protein encoding nucleic acid, respectively in a host cell results in increased tolerance and/or resistance to environmental stress as compared to the corresponding non-transformed wild type of the host cell. As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Further types of vectors can be linearized nucleic acid sequences, such as transposons, which are pieces of DNA which can copy and insert themselves. There have been 2 types of transposons found: simple transposons, known as Insertion Sequences and composite transposons, which can have several genes as well as the genes that are required for transposition.

Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as "expression vectors". In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

A plant expression cassette preferably contains regulatory sequences capable of driving gene expression in plant cells and operably linked so that each sequence can fulfill its function, for example, termination of transcription by polyadenylation signals. Preferred polyadenylation signals are those originating from *Agrobacterium tumefaciens* T-DNA such as the gene 3 known as octopine synthase of the Ti-plasmid pTiACH5 (Gielen et al., 1984 EMBO J. 3:835) or functional equivalents thereof but also all other terminators functionally active in plants are suitable.

As plant gene expression is very often not limited on transcriptional levels, a plant expression cassette preferably contains other operably linked sequences like translational enhancers such as the overdrive-sequence containing the 5"-untranslated leader sequence from tobacco mosaic virus enhancing the protein per RNA ratio (Gallie et al., 1987 Nucl. Acids Research 15:8693-8711).

Plant gene expression has to be operably linked to an appropriate promoter conferring gene expression in a timely, cell or tissue specific manner. Preferred are promoters driving constitutive expression (Benfey et al., 1989 EMBO J. 8:2195-2202) like those derived from plant viruses like the 35S CaMV (Franck et al., 1980 Cell 21:285-294), the 19S CaMV (see also U.S. Pat. No. 5,352,605 and PCT Application No. WO 8402913) or plant promoters like those from Rubisco small subunit described in U.S. Pat. No. 4,962,028.

Additional advantageous regulatory sequences are, for example, included in the plant promoters such as CaMV/35S [Franck et al., Cell 21 (1980) 285-294], PRP1 [Ward et al., Plant. Mol. Biol. 22 (1993)], SSU, OCS, lib4, usp, STLS1, B33, LEB4, nos or in the ubiquitin, napin or phaseolin promoter. Also advantageous in this connection are inducible promoters such as the promoters described in EP-A-0 388 186 (benzyl sulfonamide inducible), Plant J. 2, 1992: 397-404 (Gatz et al., Tetracyclin inducible), EP-A-0 335 528 (abscisic acid inducible) or WO 93/21334 (ethanol or cyclohexenol inducible). Additional useful plant promoters are the cytosolic FBPase promotor or ST-LSI promoter of the potato (Stockhaus et al., EMBO J. 8, 1989, 2445), the phosphorybosyl phyrophoshate amido transferase promoter of *Glycine max* (gene bank accession No. U87999) or the noden specific promoter described in EP-A-0 249 676. Additional particularly advantageous promoters are seed specific promoters which can be used for monokotyledones or dikotyledones and are described in U.S. Pat. No. 5,608,152 (napin promoter from rapeseed), WO 98145461 (phaseolin promoter from Arobidopsis), U.S. Pat. No. 5,504,200 (phaseolin promoter from *Phaseolus vulgaris*), WO 91/13980 (Bce4 promoter from *Brassica*) and Baeumlein et al., Plant J., 2, 2, 1992: 233-239 (LEB4 promoter from leguminosa). Said promoters are useful in dikotyledones. The following promoters are useful for example in monokotyledones lpt-2- or lpt-1-promoter from barley (WO 95/15389 and WO 95/23230) or hordein promoter from barley. Other useful promoters are described in WO 99/16890.

It is possible in principle to use all natural promoters with their regulatory sequences like those mentioned above for the novel process. It is also possible and advantageous in addition to use synthetic promoters.

The gene construct may also comprise further genes which are to be inserted into the organisms and which are for example involved in stress resistance. It is possible and advantageous to insert and express in host organisms regulatory genes such as genes for inducers, repressors or enzymes which intervene by their enzymatic activity in the regulation, or one or more or all genes of a biosynthetic pathway. These genes can be heterologous or homologous in origin. The inserted genes may have their own promoter or else be under the control of same promoter as the sequences of the nucleic acid of SEQ ID NO: (4n+1) for n=0 to 54 and (2n+1) for n=110 to 487 or their homologs.

The gene construct advantageously comprises, for expression of the other genes present, additionally 3' and/or 5' terminal regulatory sequences to enhance expression, which are selected for optimal expression depending on the selected host organism and gene or genes.

These regulatory sequences are intended to make specific expression of the genes and protein expression possible as mentioned above. This may mean, depending on the host organism, for example that the gene is expressed or overexpressed only after induction, or that it is immediately expressed and/or overexpressed.

The regulatory sequences or factors may moreover preferably have a beneficial effect on expression of the introduced genes, and thus increase it. It is possible in this way for the regulatory elements to be enhanced advantageously at the transcription level by using strong transcription signals such as promoters and/or enhancers. However, in addition, it is also possible to enhance translation by, for example, improving the stability of the mRNA.

Other preferred sequences for use in plant gene expression cassettes are targeting-sequences necessary to direct the gene product in its appropriate cell compartment (for review see Kermode, 1996 Crit. Rev. Plant Sci. 15(4):285-423 and references cited therein) such as the vacuole, the nucleus, all types of plastids like amyloplasts, chloroplasts, chromoplasts, the extracellular space, mitochondria, the endoplasmic reticulum, oil bodies, peroxisomes and other compartments of plant cells.

Plant gene expression can also be facilitated via an inducible promoter (for review see Gatz, 1997 Annu. Rev. Plant Physiol. Plant Mol. Biol. 48:89-108). Chemically inducible promoters are especially suitable if gene expression is wanted to occur in a time specific manner.

Table 1 lists several examples of promoters that may be used to regulate transcription of the stress related protein nucleic acid coding sequences.

TABLE 1

Examples of Tissue-specific and Stress inducible promoters in plants

| Expression | Reference |
|---|---|
| Cor78- Cold, drought, salt, ABA, wounding-inducible | Ishitani, et al., Plant Cell 9: 1935-1949 (1997). Yamaguchi-Shinozaki and Shinozaki, Plant Cell 6: 251-264 (1994). |
| Rci2A - Cold, dehydration-inducible | Capel et al., Plant Physiol 115: 569-576 (1997) |
| Rd22 - Drought, salt | Yamaguchi-Shinozaki and Shinozaki, Mol Gen Genet 238: 17-25 (1993). |
| Cor15A - Cold, dehydration, ABA | Baker et al., Plant Mol. Biol. 24: 701-713 (1994). |
| GH3- Auxin inducible | Liu et al., Plant Cell 6: 645-657 (1994) |
| ARSK1-Root, salt inducible | Hwang and Goodman, Plant J 8: 37-43 (1995). |
| PtxA - Root, salt inducible | GenBank accession X67427 |
| SbHRGP3 - Root specific | Ahn et al., Plant Cell 8: 1477-1490 (1998). |
| KST1 - Guard cell specific | Plesch et al., Plant Journal. 28(4): 455-64, (2001) |
| KAT1 - Guard cell specific | Plesch et al., Gene 249: 83-89 (2000) Nakamura et al., Plant Physiol. 109: 371-374 (1995) |
| salicylic acid inducible | PCT Application No. WO 95/19443 |
| tetracycline inducible | Gatz et al. Plant J. 2: 397-404 (1992) |
| Ethanol inducible | PCT Application No. WO 93/21334 |
| pathogen inducible PRP1 | Ward et al., 1993 Plant. Mol. Biol. 22: 361-366 |
| heat inducible hsp80 | U.S. Pat. No. 5,187,267 |
| cold inducible alpha-amylase | PCT Application No. WO 96/12814 |
| Wound-inducible pinII | European Patent No. 375091 |
| RD29A - salt-inducible | Yamaguchi-Shinozalei et al. (1993) Mol. Gen. Genet. 236: 331-340 |
| plastid-specific viral RNA-polymerase | PCT Application No. WO 95/16783 and. WO 97/06250 |

Other promotors, e.g. superpromoter (Ni et al., Plant Journal 7, 1995: 661-676), Ubiquitin promotor (Callis et al., J. Biol. Chem., 1990, 265: 12486-12493; U.S. Pat. No. 5,510,474; U.S. Pat. No. 6,020,190; Kawalleck et al., Plant. Molecular Biology, 1993, 21: 673-684) or 34S promotor (GenBank Accession numbers M59930 and X16673) were similar useful for the present invention and are known to a person skilled in the art.

Developmental stage-preferred promoters are preferentially expressed at certain stages of development. Tissue and organ preferred promoters include those that are preferentially expressed in certain tissues or organs, such as leaves, roots, seeds, or xylem. Examples of tissue preferred and organ preferred promoters include, but are not limited to fruit-preferred, ovule-preferred, male tissue-preferred, seed-preferred, integument-preferred, tuber-preferred, stalk-preferred, pericarp-preferred, and leaf-preferred, stigma-preferred, pollen-preferred, anther-preferred, a petal-preferred, sepal-preferred, pedicel-preferred, silique-preferred, stem-preferred, root-preferred promoters, and the like. Seed preferred promoters are preferentially expressed during seed development and/or germination. For example, seed preferred promoters can be embryo-preferred, endosperm preferred, and seed coat-preferred. See Thompson et al., 1989, BioEssays 10:108. Examples of seed preferred promoters include, but are not limited to, cellulose synthase (celA), Cim1, gamma-zein, globulin-1, maize 19 kD zein (cZ19B1), and the like.

Other promoters useful in the expression cassettes of the invention include, but are not limited to, the major chlorophyll a/b binding protein promoter, histone promoters, the Ap3 promoter, the β-conglycin promoter, the napin promoter, the soybean lectin promoter, the maize 15 kD zein promoter, the 22 kD zein promoter, the 27 kD zein promoter, the g-zein promoter, the waxy, shrunken 1, shrunken 2 and bronze promoters, the Zm13 promoter (U.S. Pat. No. 5,086,169), the maize polygalacturonase promoters (PG) (U.S. Pat. Nos. 5,412,085 and 5,545,546), and the SGB6 promoter (U.S. Pat. No. 5,470,359), as well as synthetic or other natural promoters.

Additional flexibility in controlling heterologous gene expression in plants may be obtained by using DNA binding domains and response elements from heterologous sources (i.e., DNA binding domains from non-plant sources). An example of such a heterologous DNA binding domain is the LexA DNA binding domain (Brent and Ptashne, 1985, Cell 43:729-736).

The invention further provides a recombinant expression vector comprising a SRP DNA molecule of the invention cloned into the expression vector in an antisense orientation. That is, the DNA molecule is operatively linked to a regulatory sequence in a manner that allows for expression (by transcription of the DNA molecule) of an RNA molecule that is antisense to a SRP mRNA. Regulatory sequences operatively linked to a nucleic acid molecule cloned in the antisense orientation can be chosen which direct the continuous expression of the antisense RNA molecule in a variety of cell types. For instance, viral promoters and/or enhancers, or regulatory sequences can be chosen which direct constitutive, tissue specific, or cell type specific expression of antisense RNA. The antisense expression vector can be in the form of a recombinant plasmid, phagemid, or attenuated virus wherein antisense nucleic acids are produced under the control of a high efficiency regulatory region. The activity of the regulatory region can be determined by the cell type into which the vector is introduced. For a discussion of the regulation of gene expression using antisense genes, see Weintraub, H. et al., 1986, Antisense RNA as a molecular tool for genetic analysis, Reviews—Trends in Genetics, Vol. 1(1), and Mol et al., 1990, FEBS Letters 268:427-430.

Another aspect of the invention pertains to host cells into which a recombinant expression vector of the invention has been introduced. The terms "host cell" and "recombinant host cell" are used interchangeably herein. It is understood that such terms refer not only to the particular subject cell but they also apply to the progeny or potential progeny of such a cell. Because certain modifications may occur in succeeding generations due to either mutation or environmental influences, such progeny may not, in fact, be identical to the parent cell, but are still included within the scope of the term as used herein. A host cell can be any prokaryotic or eukaryotic cell. For example, a SRP can be expressed in bacterial cells such as C. glutamicum, yeast, E. coli, insect cells, fungal cells, or mammalian cells (such as Chinese hamster ovary cells (CHO) or COS cells), algae, dilates, plant cells, fungi, or other microorganisms like C. glutamicum. Other suitable host cells are known to those skilled in the art.

A host cell of the invention, such as a prokaryotic or eukaryotic host cell in culture, can be used to produce (i.e., express) a SRP. Accordingly, the invention further provides methods for producing SRPs using the host cells of the invention. In one embodiment, the method comprises culturing the host cell of invention (into which a recombinant expression vector encoding a SRP has been introduced, or into which genome has been introduced a gene encoding a wild-type or altered SRP) in a suitable medium until SRP is produced. In another embodiment, the method further comprises isolating SRPs from the medium or the host cell.

Another aspect of the invention pertains to isolated SRPs, and biologically active portions thereof. An "isolated" or "purified" polypeptide or biologically active portion thereof is free of some of the cellular material when produced by recombinant DNA techniques, or chemical precursors or other chemicals when chemically synthesized. The language "substantially free of cellular material" includes preparations of SRP in which the polypeptide is separated from some of the cellular components of the cells in which it is naturally or recombinantly produced. In one embodiment, the language "substantially free of cellular material" includes preparations of a SRP having less than about 30% (by dry weight) of non-SRP material (also referred to herein as a "contaminating polypeptide"), more preferably less than about 20% of non-SRP material, still more preferably less than about 10% of non-SRP material, and most preferably less than about 5% non-SRP material.

When the SRP or biologically active portion thereof is recombinantly produced, it is also preferably substantially free of culture medium, i.e., culture medium represents less than about 20%, more preferably less than about 10%, and most preferably less than about 5% of the volume of the polypeptide preparation. The language "substantially free of chemical precursors or other chemicals" includes preparations of SRP in which the polypeptide is separated from chemical precursors or other chemicals that are involved in the synthesis of the polypeptide. In one embodiment, the language "substantially free of chemical precursors or other chemicals" includes preparations of a SRP having less than about 30% (by dry weight) of chemical precursors or non-SRP chemicals, more preferably less than about 20% chemical precursors or non-SRP chemicals, still more preferably less than about 10% chemical precursors or non-SRP chemicals, and most preferably less than about 5% chemical precursors or non-SRP chemicals. In preferred embodiments, isolated polypeptides, or biologically active portions thereof, lack contaminating polypeptides from the same organism from which the SRP is derived. Typically, such polypeptides are produced by recombinant expression of, for example, a *Saccharomyces cerevisiae, E. coli* or *Brassica napus, Glycine max, Zea mays* or *Oryza sativa* SRP in plants other than *Saccharomyces cerevisiae, E. coli*, or microorganisms such as *C. glutamicum*, ciliates, algae or fungi.

The nucleic acid molecules, polypeptides, polypeptide homologs, fusion polypeptides, primers, vectors, and host cells described herein can be used in one or more of the following methods: identification of *Saccharomyces cerevisiae, E. coli* or *Brassica napus, Glycine max, Zea mays* or *Oryza sativa* and related organisms; mapping of genomes of organisms related to *Saccharomyces cerevisiae, E. coli*; identification and localization of *Saccharomyces cerevisiae, E. coli* or *Brassica napus, Glycine max, Zea mays* or *Oryza sativa* sequences of interest; evolutionary studies; determination of SRP regions required for function; modulation of a SRP activity; modulation of the metabolism of one or more cell functions; modulation of the transmembrane transport of one or more compounds; modulation of stress resistance; and modulation of expression of SRP nucleic acids.

The SRP nucleic acid molecules of the invention are also useful for evolutionary and polypeptide structural studies. The metabolic and transport processes in which the molecules of the invention participate are utilized by a wide variety of prokaryotic and eukaryotic cells; by comparing the sequences of the nucleic acid molecules of the present invention to those encoding similar enzymes from other organisms, the evolutionary relatedness of the organisms can be assessed. Similarly, such a comparison permits an assessment of which regions of the sequence are conserved and which are not, which may aid in determining those regions of the polypeptide that are essential for the functioning of the enzyme. This type of determination is of value for polypeptide engineering studies and may give an indication of what the polypeptide can tolerate in terms of mutagenesis without losing function.

Manipulation of the SRP nucleic acid molecules of the invention may result in the production of SRPs having functional differences from the wild-type SRPs. These polypeptides may be improved in efficiency or activity, may be present in greater numbers in the cell than is usual, or may be decreased in efficiency or activity.

There are a number of mechanisms by which the alteration of a SRP of the invention may directly affect stress response and/or stress tolerance. In the case of plants expressing SRPs, increased transport can lead to improved salt and/or solute partitioning within the plant tissue and organs. By either increasing the number or the activity of transporter molecules which exportionic molecules from the cell, it may be possible to affect the salt tolerance of the cell.

The effect of the genetic modification in plants, *C. glutamicum*, fungi, algae, or ciliates on stress tolerance can be assessed by growing the modified microorganism or plant under less than suitable conditions and then analyzing the growth characteristics and/or metabolism of the plant. Such analysis techniques are well known to one skilled in the art, and include dry weight, wet weight, polypeptide synthesis, carbohydrate synthesis, lipid synthesis, evapotranspiration rates, general plant and/or crop yield, flowering, reproduction, seed setting, root growth, respiration rates, photosynthesis rates, etc. (Applications of HPLC in Biochemistry in: Laboratory Techniques in Biochemistry and Molecular Biology, vol. 17; Rehm et al., 1993 Biotechnology, vol. 3, Chapter Product recovery and purification, page 469-714, VCH: Weinheim; Better, P. A. et al., 1988, Bioseparations: downstream processing for biotechnology, John Wiley and Sons;

Kennedy, J. F. and Cabral, J. M. S., 1992, Recovery processes for biological materials, John Wiley and Sons; Shaeiwitz, J. A. and Henry, J. D., 1988, Biochemical separations, in: Utmann's Encyclopedia of Industrial Chemistry, vol. B3, Chapter 11, page 1-27, VCH: Weinheim; and Dechow, F. J., 1989, Separation and purification techniques in biotechnology, Noyes Publications).

For example, yeast expression vectors comprising the nucleic acids disclosed herein, or fragments thereof, can be constructed and transformed into *Saccharomyces cerevisiae* using standard protocols. The resulting transgenic cells can then be assayed for fail or alteration of their tolerance to drought, salt, and temperature stress. Similarly, plant expression vectors comprising the nucleic acids disclosed herein, or fragments thereof, can be constructed and transformed into an appropriate plant cell such as *Arabidopsis*, soy, rape, maize, wheat, *Medicago truncatula*, etc., using standard protocols. The resulting transgenic cells and/or plants derived therefrom can then be assayed for fail or alteration of their tolerance to drought, salt, temperature stress, and lodging.

The engineering of one or more SRP genes of the invention may also result in SRPs having altered activities which indirectly impact the stress response and/or stress tolerance of algae, plants, ciliates, or fungi, or other microorganisms like *C. glutamicum*. For example, the normal biochemical processes of metabolism result in the production of a variety of products (e.g., hydrogen peroxide and other reactive oxygen species) which may actively interfere with these same metabolic processes. For example, peroxynitrite is known to nitrate tyrosine side chains, thereby inactivating some enzymes having tyrosine in the active site (Groves, J. T., 1999, Curr. Opin. Chem. Biol. 3(2):226-235). While these products are typically excreted, cells can be genetically altered to transport more products than is typical for a wild-type cell. By optimizing the activity of one or more PKSRPs of the invention which are involved in the export of specific molecules, such as salt molecules, it may be possible to improve the stress tolerance of the cell.

Additionally, the sequences disclosed herein, or fragments thereof, can be used to generate knockout mutations in the genomes of various organisms, such as bacteria, mammalian cells, yeast cells, and plant cells (Girke, T., 1998, The Plant Journal 15:39-48). The resultant knockout cells can then be evaluated for their ability or capacity to tolerate various stress conditions, their response to various stress conditions, and the effect on the phenotype and/or genotype of the mutation. For other methods of gene inactivation, see U.S. Pat. No. 6,004,804 "Non-Chimeric Mutational Vectors" and Puttaraju et al., 1999, Spliceosome-mediated RNA trans-splicing as a tool for gene therapy, Nature Biotechnology 17:246-252.

The aforementioned mutagenesis strategies for SRPs resulting in increased stress resistance are not meant to be limiting; variations on these strategies will be readily apparent to one skilled in the art. Using such strategies, and incorporating the mechanisms disclosed herein, the nucleic acid and polypeptide molecules of the invention may be utilized to generate algae, ciliates, plants, fungi, or other microorganisms like *C. glutamicum* expressing mutated PKSRP nucleic acid and polypeptide molecules such that the stress tolerance is improved.

The present invention also provides antibodies that specifically bind to a SRP, or a portion thereof, as encoded by a nucleic acid described herein. Antibodies can be made by many well-known methods (See, e.g. Harlow and Lane, "Antibodies; A Laboratory Manual," Cold Spring Harbor Laboratory, Cold Spring Harbor, N.Y., (1988)). Briefly, purified antigen can be injected into an animal in an amount and in intervals sufficient to elicit an immune response. Antibodies can either be purified directly, or spleen cells can be obtained from the animal. The cells can then fused with an immortal cell line and screened for antibody secretion. The antibodies can be used to screen nucleic acid clone libraries for cells secreting the antigen. Those positive clones can then be sequenced. See, for example, Kelly et al., 1992, Bio/Technology 10:163-167; Bebbington et al., 1992, Bio/Technology 10:169-175.

The phrases "selectively binds" and "specifically binds" with the polypeptide refer to a binding reaction that is determinative of the presence of the polypeptide in a heterogeneous population of polypeptides and other biologics. Thus, under designated immunoassay conditions, the specified antibodies bound to a particular polypeptide do not bind in a significant amount to other polypeptides present in the sample. Selective binding of an antibody under such conditions may require an antibody that is selected for its specificity for a particular polypeptide. A variety of immunoassay formats may be used to select antibodies that selectively bind with a particular polypeptide. For example, solid-phase ELISA immunoassays are routinely used to select antibodies selectively immunoreactive with a polypeptide. See Harlow and Lane, "Antibodies, A Laboratory Manual," Cold Spring Harbor Publications, New York, (1988), for a description of immunoassay formats and conditions that could be used to determine selective binding.

In some instances, it is desirable to prepare monoclonal antibodies from various hosts. A description of techniques for preparing such monoclonal antibodies may be found in Stites et al., eds., "Basic and Clinical Immunology," (Lange Medical Publications, Los Altos, Calif., Fourth Edition) and references cited therein, and in Harlow and Lane, "Antibodies, A Laboratory Manual," Cold Spring Harbor Publications, New York, (1988).

Gene expression in plants is regulated by the interaction of protein transcription factors with specific nucleotide sequences within the regulatory region of a gene. A common type of transcription factor contains zinc finger (ZF) motifs. Each ZF module is approximately 30 amino acids long folded around a zinc ion. The DNA recognition domain of a ZF protein is a α-helical structure that inserts into the major grove of the DNA double helix. The module contains three amino acids that bind to the DNA with each amino acid contacting a single base pair in the target DNA sequence. ZF motifs are arranged in a modular repeating fashion to form a set of fingers that recognize a contiguous DNA sequence. For example, a three-fingered ZF motif will recognize 9 bp of DNA. Hundreds of proteins have been shown to contain ZF motifs with between 2 and 37 ZF modules in each protein (Isalan M, et al., 1998 Biochemistry 37(35):12026-33; Moore M, et al., 2001 Proc. Natl. Acad. Sci. USA 98(4):1432-1436 and 1437-1441; U.S. Pat. Nos. 6,007,988 and 6,013,453).

The regulatory region of a plant gene contains many short DNA sequences (cis-acting elements) that serve as recognition domains for transcription factors, including ZF proteins. Similar recognition domains in different genes allow the coordinate expression of several genes encoding enzymes in a metabolic pathway by common transcription factors. Variation in the recognition domains among members of a gene family facilitates differences in gene expression within the same gene family, for example, among tissues and stages of development and in response to environmental conditions.

Typical ZF proteins contain not only a DNA recognition domain but also a functional domain that enables the ZF protein to activate or repress transcription of a specific gene. Experimentally, an activation domain has been used to activate transcription of the target gene (U.S. Pat. No. 5,789,538 and patent application WO9519431), but it is also possible to link a transcription repressor domain to the ZF and thereby inhibit transcription (patent applications WO00/47754 and WO2001002019). It has been reported that an enzymatic function such as nucleic acid cleavage can be linked to the ZF (patent application WO00/20622)

The invention provides a method that allows one skilled in the art to isolate the regulatory region of one or more stress related protein encoding genes from the genome of a plant cell and to design zinc finger transcription factors linked to a functional domain that will interact with the regulatory region of the gene. The interaction of the zinc finger protein with the plant gene can be designed in such a manner as to alter expression of the gene and preferably thereby alter metabolic activity to confer increased (or decreased) tolerance of abiotic stress such as drought. The invention provides a method of producing a transgenic plant with a transgene encoding this designed transcription factor, or alternatively a natural transcription factor, that modifies transcription of the Stress-Related Protein, particularly stress related protein gene to provide increased tolerance of environmental stress. Such a regulation of plant genes by artificial polydactyl zinc fingers has been demonstrated by Ordiz et al. (Regulation of transgene Expression in plants with polydactyl zinc finger transcription factors, Ordiz et al., PNAS, 99 (20) 13290-13295, 2002) or Guan et al. (Hertiable endogenous gene regulation in plants with designed polydactyl zinc finger transcription factors, PNAS, Vol. 99 (20), 13296-13301 (2002)).

In particular, the invention provides a method of producing a transgenic plant with a stress related protein coding nucleic acid, wherein expression of the nucleic acid(s) in the plant results in increased tolerance to environmental stress as compared to a wild type plant comprising: (a) transforming a plant cell with an expression vector comprising a stress related protein encoding nucleic acid, and (b) generating from the plant cell a transgenic plant with an increased tolerance to environmental stress as compared to a wild type plant. For such plant transformation, binary vectors such as pBinAR can be used (Höfgen and Willmitzer, 1990 Plant Science 66:221-230). Moreover suitable binary vectors are for example pBN19, pBI101, pGPTV or pPZP (Hajukiewicz, P. et al., 1994, Plant Mol. Biol., 25: 989-994).

Construction of the binary vectors can be performed by ligation of the cDNA into the T-DNA. 5' to the cDNA a plant promoter activates transcription of the cDNA. A polyadenylation sequence is located 3' to the cDNA. Tissue-specific expression can be achieved by using a tissue specific promoter as listed above. Also, any other promoter element can be used. For constitutive expression within the whole plant, the CaMV 35S promoter can be used. The expressed protein can be targeted to a cellular compartment using a signal peptide, for example for plastids, mitochondria or endoplasmic reticulum (Kermode, 1996 Crit. Rev. Plant Sci. 4(15): 285-423). The signal peptide is cloned 5' in frame to the cDNA to archive subcellular localization of the fusion protein. Additionally, promoters that are responsive to abiotic stresses can be used with, such as the *Arabidopsis* promoter RD29A. One skilled in the art will recognize that the promoter used should be operatively linked to the nucleic acid such that the promoter causes transcription of the nucleic acid which results in the synthesis of a mRNA which encodes a polypeptide.

Alternate methods of transfection include the direct transfer of DNA into developing flowers via electroporation or *Agrobacterium* mediated gene transfer. *Agrobacterium* mediated plant transformation can be performed using for example the GV3101(pMP90) (Koncz and Schell, 1986 Mol. Gen. Genet. 204:383-396) or LBA4404 (Ooms et al., Plasmid, 1982, 7: 15-29; Hoekema et al., Nature, 1983, 303: 179-180) *Agrobacterium tumefaciens* strain. Transformation can be performed by standard transformation and regeneration techniques (Deblaere et al., 1994 Nucl. Acids. Res. 13:4777-4788; Gelvin and Schilperoort, Plant Molecular Biology Manual, 2nd Ed.—Dordrecht: Kluwer Academic Publ., 1995.—in Sect., Ringbuc Zentrale Signatur: BT11-P ISBN 0-7923-2731-4; Glick, B R and Thompson, J E, Methods in Plant Molecular Biology and Biotechnology, Boca Raton: CRC Press, 1993.—360 S., ISBN 0-8493-5164-2). For example, rapeseed can be transformed via cotyledon or hypocotyl transformation (Moloney et al., 1989 Plant Cell Reports 8:238-242; De Block et al., 1989 Plant Physiol. 91:694-701). Use of antibiotics for *Agrobacterium* and plant selection depends on the binary vector and the *Agrobacterium* strain used for transformation. Rapeseed selection is normally performed using kanamycin as selectable plant marker. *Agrobacterium* mediated gene transfer to flax can be performed using, for example, a technique described by Mlynarova et al., 1994 Plant Cell Report 13:282-285. Additionally, transformation of soybean can be performed using for example a technique described in European Patent No. 0424 047, U.S. Pat. No. 5,322,783, European Patent No. 0397 687, U.S. Pat. No. 5,376,543 or U.S. Pat. No. 5,169,770. Transformation of maize can be achieved by particle bombardment, polyethylene glycol mediated DNA uptake or via the silicon carbide fiber technique (see, for example, Freeling and Walbot "The maize handbook" Springer Verlag: New York (1993) ISBN 3-540-97826-7). A specific example of maize transformation is found in U.S. Pat. No. 5,990,387 and a specific example of wheat transformation can be found in PCT Application No. WO 93/07256.

The stress related protein encoding nucleic acid molecules of the invention have a variety of uses. Most importantly, the nucleic acid and amino acid sequences of the present invention can be used to transform plant cells or plants, thereby inducing tolerance to stresses such as drought, high salinity and cold. The present invention therefore provides a transgenic plant transformed by a stress related protein encoding nucleic acid (coding or antisense), wherein expression of the nucleic acid sequence in the plant results in increased tolerance to environmental stress as compared to a wild type plant. The increased stress tolerance is apparent as an increase in the yield or quality of the plant. The transgenic plant can be a monocot or a dicot or a gymnosperm plant. The invention further provides that the transgenic plant can be selected from maize, wheat, rye, oat, triticale, rice, barley, soybean, peanut, cotton, borage, sunflower, linseed, primrose, rapeseed, canola and turnip rape, manihot, pepper, sunflower, tagetes, solanaceous plant such as potato, tobacco, eggplant and tomato, *Vicia* species, pea, alfalfa, bushy plants such as coffee, cacao, tea, *Salix* species, trees such as oil palm, coconut, perennial grass, such as ryegrass and fescue, and forage crops, such as alfalfa and clover and *Arabidopsis thaliana*. Further the transgenic plant can be selected from spruce, pine or fir for example.

In particular, the present invention describes using the expression of stress related proteins to engineer drought-tolerant, salt-tolerant and/or cold-tolerant plants. This strategy has herein been demonstrated for *Arabidopsis thaliana*, Ryegrass, Alfalfa, Rapeseed/Canola, Soybean, Corn and Wheat but its application is not restricted to these plants. Accordingly, the invention provides a transgenic plant containing a stress related protein encoding gene selected from the nucleic acid of SEQ ID NO: (4n+1) for n=0 to 54 and (2n+1) for n=110 to 487 and/or homologs of the afore mentioned sequences, wherein the environmental stress is drought, increased salt or decreased or increased temperature but its application is not restricted to these adverse environments. Protection against other adverse conditions such as heat, air pollution, heavy metals and chemical toxicants, for example, may be obtained. In preferred embodiments, the environmental stress is drought.

The present invention also provides methods of modifying stress tolerance of a plant comprising, modifying the expression of a stress related protein encoding gene in the plant. The invention provides that this method can be performed such that the stress tolerance is increased. This can for example be done by the use of transcription factors. In particular, the present invention provides methods of producing a transgenic plant having an increased tolerance to environmental stress as compared to a wild type plant due to increased expression of a stress related protein in the plant.

Growing the modified plants under stress conditions and then screening and analyzing the growth characteristics and/or metabolic activity assess the effect of the genetic modification in plants on stress tolerance and/or resistance. Such analysis techniques are well known to one skilled in the art. They include next to screening (Römpp Lexikon Biotechnologie, Stuttgart/New York: Georg Thieme Verlag 1992, "screening" p. 701) dry weight, wet weight, protein synthesis, carbohydrate synthesis, lipid synthesis, evapotranspiration rates, general plant and/or crop yield, flowering, reproduction, seed setting, root growth, respiration rates, photosynthesis rates, etc. (Applications of HPLC in Biochemistry in: Laboratory Techniques in Biochemistry and Molecular Biology, vol. 17; Rehm et al., 1993 Biotechnology, vol. 3, Chapter III: Product recovery and purification, page 469-714, VCH Weinheim; Better, P. A. et al., 1988 Bioseparations: downstream processing for biotechnology, John Wiley and Sons; Kennedy, J. F. and Cabral, J. M. S., 1992 Recovery processes for biological materials, John Wiley and Sons; Shaeiwitz, J. A. and Henry, J. D., 1988 Biochemical separations, in: Ulmann's Encyclopedia of Industrial Chemistry, vol. B3, Chapter 11, page 1-27, VCH: Weinheim; and Dechow, F. J. (1989) Separation and purification techniques in biotechnology, Noyes Publications).

The engineering of one or more stress related protein encoding genes of the invention may also result in stress related proteins having altered activities which indirectly impact the stress response and/or stress tolerance of plants. For example, the normal biochemical processes of metabolism result in the production of a variety of products (e.g., hydrogen peroxide and other reactive oxygen species) which may actively interfere with these same metabolic processes (for example, peroxynitrite is known to react with tyrosine side chains, thereby inactivating some enzymes having tyrosine in the active site (Groves, J. T., 1999 Curr. Opin. Chem. Biol. 3(2):226-235). By optimizing the activity of one or more stress related proteins (enzymes) of the invention, it may be possible to improve the stress tolerance of the cell.

Throughout this application, various publications are referenced. The disclosures of all of these publications and those references cited within those publications in their entireties are hereby incorporated by reference into this application in order to more fully describe the state of the art to which this invention pertains.

It should also be understood that the foregoing relates to preferred embodiments of the present invention and that numerous changes and variations may be made therein without departing from the scope of the invention. The invention is further illustrated by the following examples, which are not to be construed in any way as limiting. On the contrary, it is to be clearly understood that various other embodiments, modifications and equivalents thereof, which, after reading the description herein, may suggest themselves to, those skilled in the art without departing from the spirit of the present invention and/or the scope of the claims.

The invention also pertains to the use of SRP encoding nucleic acid selected form the group comprising the nucleic acid of SEQ ID NO: (4n+1) for n=0 to 54 and (2n+1) for n=110 to 487 and/or homologs of the afore mentioned sequences for preparing a plant cell with increased environmental stress tolerance. The said sequences can also be used for preparing a plant with increased environmental stress tolerance.

Object of the invention is further the use of increased tolerance and/or resistance to environmental stress and/or a SRP encoding nucleic acid selected form the group of sequences of the nucleic acid of SEQ ID NO: (4n+1) for n=0 to 54 and (2n+1) for n=110 to 487 and/or homologs of the afore mentioned sequences or parts thereof as markers for selection of plants with increased tolerance to environmental stress or as markers for detection of stress in plants or plant cells.

EXAMPLE 1

Engineering Stress-Tolerant *Arabidopsis* Plants by Over-Expressing Stress Related Protein Genes Gene cloning and transformation of *Arabidopsis thaliana*
Amplification The standard protocol of RNA extraction (Qiagen) and cDNA production (Invitrogen) is used for the isolation procedure of RNA from different tissues of *Brassica napus*, *Glycine max*, *Zea mays* or *Oryza sativa* and synthesis of ther respective cDNA.

The standard protocol of Pfu DNA polymerase or a Pfu/Taq DNA polymerase mix (Herculase) was used for the amplification procedure. Amplified ORF fragments were analysed by gel electrophoresis. Each primer consists of a universal 5' end and ORF specific 3' end whereby the universal sequences differ for the forward and reverse primers (forward primer sequence contains an EcoRI for yeast or SmaI for *E. coli* and the reverse primer sequence a SmaI for yeast or SacI for *E. coli* restriction site) allowing generally a unidirectional cloning success.

Amplification using the protocol of Pfu or Herculase DNA polymerase (Stratagene). Conditions: 1×PCR buffer, 0.2 mM dNTP, 100 ng genomic DNA *Saccharomyces cerevisiae* (S288C) or 60 ng genomic DNA *Escherichia coli* K-12 (MG1655), 25 μmol forward primer, 25 μmol reverse primer, 2.5 α Pfu or Herculase DNA polymerase. 1st cycle for 3' for yeast of 2' for *E. coli* at 94° C., followed by 25 cycles for 30" at 94° C., 30" 55° C. for yeast or 60° C. for *E. coli* and 5-6' 72° C., followed by 1 cycle for 610' at 72° C., final for 4° C. at ∞.

Table 2: Forward and reverse primer sequences used for ORF amplification

| SEQ ID NO: | Gene | Forward Seq |
|---|---|---|
| 3 | B0019 | TTGCTCTTCCATGAAACATCTGCATCGATTCTTTAG |
| 7 | B0730 | TTGCTCTTCCATGGGACACAAGCCCTTATACCG |
| 11 | B1528 | TTGCTCTTCCATGACAACAAACACTGTTTCCCGC |
| 15 | B1829 | TTGCTCTTCCATGATGCGAATCGCGCTCTTCC |
| 19 | B2170 | TTGCTCTTCCATGCATAACTCCCCCGCAGTC |
| 23 | B3164 | TTGCTCTTCCATGCGCAGAAGATCGGGTATTAAC |
| 27 | YBL002W | GGAATTCCAGCTGACCACCATGTCCTCTGCCGCCGAAAAGAA |
| 31 | YBR002C | GGAATTCCAGCTGACCACCATGGAAACGGATAGTGGTATACCT |
| 35 | YBR010W | GGAATTCCAGCTGACCACCATGGCCAGAACAAAGCAAACAGCA |
| 39 | YBR090c | GGAATTCCAGCTGACCACCATGGTACCCGCACCTGGGTCA |
| 43 | YBR109C | GGAATTCCAGCTGACCACCATGTCCTCCAATCTTACCGAAGAA |
| 47 | YBR288C | GGAATTCCAGCTGACCACCATGTATTTGTCATTCTATATCACTGAT |
| 51 | YCR087W | GGAATTCCAGCTGACCACCATGTCTATATATCTACACATAAAATTCC |
| 55 | YEL001C | GGAATTCCAGCTGACCACCATGAGGTTTTCTATGTTAATCGGGT |
| 59 | YER062c | GGAATTCCAGCTGACCACCATGGGATTGACTACTAAACCTCTAT |
| 63 | YER145C | GGAATTCCAGCTGACCACCATGCCTAACAAAGTGTTTAACGTGG |
| 67 | YER146W | GGAATTCCAGCTGACCACCATGAGTCTACCGGAGATTTTGCCT |
| 71 | YGL151W | GGAATTCCAGCTGACCACCATGGAAAAAGAATCAGTATACAACTTA |
| 75 | YGR046W | GGAATTCCAGCTGACCACCATGAGCATTCTATCATCCACACAAT |
| 79 | YGR060W | GGAATTCCAGCTGACCACCATGTCTGCCGTTTTCAACAACGCT |
| 83 | YGR141W | GGAATTCCAGCTGACCACCATGCGAATCTCAAAAAATAGTCATAAG |
| 87 | YHR214W-A | GGAATTCCAGCTGACCACCATGCCACAAGTACAGTCGTGGTTT |
| 91 | YIL002C | GGAATTCCAGCTGACCACCATGAGACTCTTCATCGGTAGAAGAT |
| 95 | YIL031W | GGAATTCCAGCTGACCACCATGTCTGCCAGAAAACGCAAGTTTA |
| 99 | YIL076W | GGAATTCCAGCTGACCACCATGCAGCGTCTTCAATGGGATAAA |
| 103 | YIL077C | GGAATTCCAGCTGACCACCATGTTGGGAAAAGAAGAAGAACAGC |
| 107 | YIL121W | GGAATTCCAGCTGACCACCATGGCAGGAGCAACATCAAGTATAA |
| 111 | YIL156W | GGAATTCCAGCTGACCACCATGCTAGACGATGATAAGGGCAC |
| 115 | YJR044C | GGAATTCCAGCTGACCACCATGATGGAATTCAAAGTGTCACCAT |
| 119 | YKL057C | GGAATTCCAGCTGACCACCATGGCATGCCTCTCAAGAATTGAT |
| 123 | YKL150W | GGAATTCCAGCTGACCACCATGTTTTCCAGATTATCCAGATCTC |
| 127 | YKR057W | GGAATTCCAGCTGACCACCATGGAAAACGATAAGGGCCAATTAG |
| 131 | YLR062c | GGAATTCCAGCTGACCACCATGAATTTATTCTTCGTCTTCTTCTTC |
| 135 | YLR142W | GGAATTCCAGCTGACCACCATGATAGCTTCCAAAAGCTCCTTAT |
| 139 | YLR173W | GGAATTCCAGCTGACCACCATGCACACTAACTCACCCTTACGA |
| 143 | YLR210W | GGAATTCCAGCTGACCACCATGATGCTTGAAGGGTATACGGTA |
| 147 | YLR274W | GGAATTCCAGCTGACCACCATGTCATTTGATAGACCGGAAATATA |

Table 2: Forward and reverse primer sequences used for ORF amplification
Table 2: Forward and reverse primer sequences used for ORF amplification

| | | |
|---|---|---|
| 151 | YLR394W | GGAATTCCAGCTGACCACCATGGGCGGCTATTTGGCGATCG |
| 155 | YNL108C | GGAATTCCAGCTGACCACCATGGCTATCGAAAATATATACATTGC |
| 159 | NL141W | GGAATTCCAGCTGACCACCATGGTTTCTGTGGAGTTTTTACAGG |
| 163 | YNL231C | GGAATTCCAGCTGACCACCATGTTCAAGAGATTTAGCAAAAAGAAG |
| 167 | YNL282W | GGAATTCCAGCTGACCACCATGTCCGGGTCGTTAAAATCTCTA |
| 171 | YNL283C | GGAATTCCAGCTGACCACCATGCACCTAGATCTCATACACAAGT |
| 175 | YNL286W | GGAATTCCAGCTGACCACCATGGATGCTGATGAATTGGAATTGA |
| 179 | YNR029C | GGAATTCCAGCTGACCACCATGTCTGCATTGAGAAACATCAAGT |
| 183 | YOL056W | GGAATTCCAGCTGACCACCATGACTGTTACTGACACTTTTAAACT |
| 187 | YOR102W | GGAATTCCAGCTGACCACCATGCAAGCACGCCGGCAAACC |
| 191 | YOR154W | GGAATTCCAGCTGACCACCATGGCGAACCGTCTTCTCATATAC |
| 195 | YOR170W | GGAATTCCAGCTGACCACCATGATATATAACTGGGGATGTATAATT |
| 199 | YOR266W | GGAATTCCAGCTGACCACCATGGATTCTCGAGTTGCACTGGTA |
| 203 | YOR298C-A | GGAATTCCAGCTGACCACCATGATTACGCAGAATTCTATACCAG |
| 207 | YPL030W | ATGACTGGCGACGGTAGTGCAC |
| 211 | YPL103C | GGAATTCCAGCTGACCACCATGGAGGAACAACGTGAAATACTG |
| 215 | YPL136W | GGAATTCCAGCTGACCACCATGGCGTCTACGGTAGCCGGAT |
| 219 | YPL211W | GGAATTCCAGCTGACCACCATGAGACAGCTAACAGAAGAAGAGA |

| SEQ ID NO: | Gene | Reverse Seq |
|---|---|---|
| 4 | B0019 | TTGCTCTTCGTTAAACTGATGGACGCAAACGAACG |
| 8 | B0730 | TTGCTCTTCGTTATCGCGATGATTTTCGCTGCG |
| 12 | B1528 | TIGCTCTTCGTTATTGCGTCTGTTCTTCGAGTGTC |
| 16 | B1829 | TTGCTCTTCGTTACTTCAGGTATTCACCCGTACG |
| 20 | B2170 | TTGCTCTTCGTTAAACATCTTTAATCCGCAGTAAGC |
| 24 | B3164 | TTGCTCTTCGTTACTCGCCCTGTTCAGCAGCC |
| 28 | YBL002W | GATCCCCGGGAATTGCCATGTTAGGCTTGAGTAGAGGAGGAGTA |
| 32 | YBR002C | GATCCCCGGGAATTGCCATGTTAATTCAACTTTTTTTCTTTCAAATCG |
| 36 | YBR010W | GATCCCCGGGAATTGCCATGCTATGATCTTTCACCTCTTAATCTTC |
| 40 | YBR090c | GATCCCCGGGAATTGCCATGTTACGTCAGGATTCTCGGAACGG |
| 44 | YBR109C | GATCCCCGGGAATTGCCATGCTATTTAGATAACAAAGCAGCGAATT |
| 48 | YBR288C | GATCCCCGGGAATTGCCATGCTACAGCCTTACTTGAAAATTGCCT |
| 52 | YCR087W | GATCCCCGGGAATTGCCATGTCAAGAAATATTTGTTATTACAGGATG |
| 56 | YEL001C | GATCCCCGGGAATTGCCATGTTATTTTTTATAGGTTTCTGGCAACC |
| 60 | YER062c | GATCCCCGGGAATTGCCATGTTACCATTTCAACAGATCGTCCTTA |
| 64 | YER145C | GATCCCCGGGAATTGCCATGTCAAAGAGAGTCGGCTTTAACGTG |
| 68 | YER146W | GATCCCCGGGAATTGCCATGTTACAACGCCTCCGTAGGGGTC |
| 72 | YGL151W | GATCCCCGGGAATTGCCATGTCAGAATACGCATGTTTTCAGCATA |
| 76 | YGR046W | GATCCCCGGGAATTGCCATGTTAACTACTTGAGTTTTCTTTCCAGC |

Table 2: Forward and reverse primer sequences used for ORF amplification
Table 2: Forward and reverse primer sequences used for ORF amplification

| | | |
|---|---|---|
| 80 | YGR060W | GATCCCCGGGAATTGCCATGTTAGTTAGTCTTCTTTTGAGCATTGT |
| 84 | YGR141W | GATCCCCGGGAATTGCCATGTTACCCTGTAAAGTAGTCCATAATG |
| 88 | YHR214W-A | GATCCCCGGGAATTGCCATGTCAAACCAGCAGCCATACCTTCG |
| 92 | YIL002C | GATCCCCGGGAATTGCCATGTTACCTTTCTATAAAAAGTGGCTCAT |
| 96 | YIL031W | GATCCCCGGGAATTGCCATGTCAAGGGTCTTCATCTTCCAAGAG |
| 100 | YIL076W | GATCCCCGGGAATTGCCATGTCAGTTGGACGTATCATATTTCCTC |
| 104 | YIL077C | GATCCCCGGGAATTGCCATGCTAGGAGCGGTTCCCACCATAT |
| 108 | Y1L121W | GATCCCCGGGAATTGCCATGTTAATTTACTCCCAGTTCTTGCTTTT |
| 112 | YIL156W | GATCCCCGGGAATTGCCATGCTAGTCATAAACCCTTTCATAAAACA |
| 116 | YJR044C | GATCCCCGGGAATTGCCATGTTAACCAAAAAGGGAATCATCTTCG |
| 120 | YKL057C | GATCCCCGGGAATTGCCATGCTATAGACCTCGTAACTCATCTCTT |
| 124 | YKL150W | GATCCCCGGGAATTGCCATGTTAAAATTTGAAAACTTGGTCCTTGG |
| 128 | YKR057W | GATCCCCGGGAATTGCCATGTTAACGTGAGTAAGACCAGACGTT |
| 132 | YLR062c | GATCCCCGGGAATTGCCATGTTAATTTTTTTGATATAGACTTCCAGAA |
| 136 | YLR142W | GATCCCCGGGAATTGCCATGTCATAGGCCTACTCTTTTTGGAATC |
| 140 | YLRI73W | GATCCCCGGGAATTGCCATGTCACGTGACCAAAGTGTCACCCT |
| 144 | YLR210W | GATCCCCGGGAATTGCCATGTTAGGCTTCTGTCGAAACAATCCAT |
| 148 | YLR274W | GATCCCCGGGAATTGCCATGTCATACACCACTTCTGTAAATATTCT |
| 152 | YLR394W | GATCCCCGGGAATTGCCATGTTACCTAATCCTTCTAAACTTATTGTT |
| 156 | YNL108C | GATCCCCGGGAATTGCCATGTCACTCCATTTTTAGTTTTCCGCTC |
| 160 | YNL141W | GATCCCCGGGAATTGCCATGCTAATGCGAATATTTAGTGACTACTT |
| 164 | YNL231C | GATCCCCGGGAATTGCCATGTTACACGGTACTGCTTTCCGATTTT |
| 168 | YNL282W | GATCCCCGGGAATTGCCATGCTACTTTTGCCTCTTCTTCGAGAC |
| 172 | YNL283C | GATCCCCGGGAATTGCCATGTCAGCGCAAAGAACTATTATTGGAA |
| 176 | YNL286W | GATCCCCGGGAATIGCCATGCTATATAAGGTCATCTTCCACTTCG |
| 180 | YNR029C | GATCCCCGGGAATTGCCATGTCATATTTTAATGGTTTTTGGCTTGC |
| 184 | YOL056W | GATCCCCGGGAATTGCCATGTCATGGATTCTTTTCGAAACCCTCA |
| 188 | YOR102W | GATCCCCGGGAATTGCCATGTCAAGAAACTITCAAGACTTCTAAGA |
| 192 | YOR154W | GATCCCCGGGAATTGCCATGTCATCTGATTGCTTGTTGAACAATG |
| 196 | YOR170W | GATCCCCGGGAATTGCCATGTTATAAGATTATACCAAAGTGGAGTC |
| 200 | YOR266W | GATCCCCGGGAATTGCCATGCTATTGAATATCTTTCGTAGCTACC |
| 204 | YOR298C-A | GATCCCCGGGAATTGCCATGTCAGTTTCTTCCAAATATATACAAATG |
| 208 | YPL030W | TTAATACGCCTGTATAAATAATAAAATG |
| 212 | YPL103C | GATCCCCGGGAATTGCCATGTCACAACTCGCCGAATTCATCGTA |
| 216 | YPL136W | GATCCCCGGGAATTGCCATGCTAGGTTATGATAACTAACACCGAG |
| 220 | YPL211W | GATCCCCGGGAATTGCCATGCTAAGTAAACAAGGTGTCTTCATCT |

Vector Preparation

The preferred binary vector 1bxbigResgen for yeast and 1bxSuperCoLic for *E. coli*, which is based on the modified pPZP binary vector backbone (comprising the kanamycin-gene for bacterial selection; Hajukiewicz, P. et al., 1994, Plant Mol. Biol., 25: 989-994) carried the selection marker bar-gene (De Block et al., 1987, EMBO J. 6, 2513-2518) driven by the mas1' promoter (Velten et al., 1984, EMBO J. 3, 2723-2730; Mengiste, Amedeo and Paszkowski, 1997, Plant J., 12, 945-948) on its T-DNA. In addition the T-DNA contained the strong double 35S (Kay et al., 1987, Science 236, 1299-1302) for yeast or Super promotor (Ni et al., 1995, Plant Journal 7, 661-676) for *E. coli* in front of a cloning cassette followed by the nos-terminator (Depicker A. Stachel S. Dhaese P. Zambryski P. Goodman H M. Nopaline synthase: transcript mapping and DNA sequence. Journal of Molecular & Applied Genetics. 1(6):561-73, 1982.). The cloning cassette consists of the following sequence:

```
                                          (SEQ ID NO: 975)
5'-TTG CTC TTC CAT GGC AAT GAT TAA TTA ACG AAG
AGC AA-3'.

(SEQ ID NO: 976)
Yeast:
5'-GGAATTCCAGCTGACCACCATGGCAATTCCCGGGGATC-3
or (SEQ ID NO: 977)
E. coli:
5'-TTG CTC TTC CAT GGC AAT GAT TAA TTA ACG AAG
AGC AA-3',
respectively.
```

Other selection marker systems, like the AHAS marker or other promotors, e.g. superpromoter (see above), 35S promotor (see above), Ubiquitin promotor (Callis et al., J. Biol. Chem., 1990, 265: 12486-12493; U.S. Pat. No. 5,510,474; 6,020,190; Kawalleck et al., Plant. Molecular Biology, 1993, 21: 673-684) or 34S promotor (GenBank Accession numbers M59930 and X16673) were similar useful for the instant invention and are known to a person skilled in the art. The vector was linearised with EcoR and SmaI for yeast or SmaI and SacI for *E. coli* using the standard protocol provided by the supplier (MBI Fermentas, Germany) and purified using Qiagen columns (Qiagen, Hilden, Germany).

Ligation and Transformation

Present. ORF fragments (~100 ng) were digested by EcoRI and SmaI for yeast and SmaI and SacI for *E. coli* using the standard protocol provided by the supplier' (MBI Fermentas, Germany), purified using Qiagen columns (Qiagen, Hilden, Germany) and were ligated into the cloning cassette of the binary vector systems (~30 ng) using standard procedures (Maniatis et al.).

In the case of internal EcoRI, SmaI and SacI restriction sites a blunt end cloning procedure was applied. The undigested ORF fragments were directly purified and ligated into the cloning cassette of the binary vector. In this case the EcoRI site was refilled by Klenow reaction and the SacI site blunted Pfu DNA polymerase.

Ligation products were transformed into *E. coli* (DH5alpha) using a standard heat shock protocol (Maniatis et al.). Transformed colonies were grown on LB media and selected by respective antibiotica (Km) for 16 h at 37° C. Positive clones were identified by control PCR reactions using a combination of a vector specific and the respective ORF specific primers.

Plasmid Preparation

Plasmid DNA was prepared from positive clones using standard protocols (Qiagen Hilden, Germany).

Transformation of *Agrobacteria*

Plasmids were transformed into *Agrobacterium tumefaciens* (GV3101 pMP90; Koncz and Schell, 1986, Mol. Gen. Genet. 204: 383-396) using heat shock or electroporation protocols. Transformed colonies were grown on YEP media and selected by respective antibiotics (Rif/Gent/Km) for 2 d at 28° C. These *Agrobacterium* cultures were used for the plant transformation.

*Arabidopsis* thaliana was grown and transformed according to standard conditions Bechtold 1993 (Bechtold, N., Ellis, J., Pelletier, G. 1993. In planta *Agrobacterium* mediated gene transfer by infiltration of *Arabidopsis thaliana* plants C.R. Acad. Sci. Paris. 316:1194-1199); Bent et al. 1994 (Bent, A., Kunkel, B. N., Dahlbeck, D., Brown, K. L., Schmidt, R., Giraudat, J., Leung, J., and Staskawicz, B. J. 1994; PPCS2 of *Arabidopsis thaliana*: A leucin-rich repeat class of plant disease resistant genes; Science 265: 1856-1860).

Transgenic *A. thaliana* plants were grown individually in pots containing a 4:1 (v/v) mixture of soil and quartz sand in a York growth chamber. Standard growth conditions were: photoperiod of 16 h light and 8 h dark, 20° C., 60% relative humidity, and a photon flux density of 150 µE. To induce germination, sown seeds were kept at 4° C., in the dark, for 3 days. Plants were watered daily until they were approximately 3 weeks old at which time drought was imposed by withholding water. Parallely, the relative humidity was reduced in 10% increments every second day to 20%. After approximately 12 days of withholding water, most plants showed visual symptoms of injury, such as wilting and leaf browning, whereas tolerant plants were identified as being visually turgid and healthy green in color. Plants were scored for symptoms of drought injury in comparison to neighbouring plants for 3 days in succession.

Three successive experiments were conducted. In the first experiment, 10 independent T2 lines were sown for each gene being tested. The percentage of plants not showing visual symptoms of injury was determined. In the second experiment, the lines that had been scored as tolerant in the first experiment were put through a confirmation screen according to the same experimental procedures. In this experiment, plants of each tolerant line were grown and treated as before. In the third experiment, at least 7 replicates of the most tolerant line were grown and treated as before. The average and maximum number of days of drought survival after wild-type control had visually died were determined. Additionally measurements of chlorophyll fluorescence were made in stressed and non-stressed plants using a Mini-PAM (Heinz Walz GmbH, Effeltrich, Germany).

In the first experiment, after 12 days of drought, the control, non-transgenic *Arabidopsis thaliana* and most transgenic lines expressing other transgenes in the test showed extreme visual symptoms of stress including necrosis and cell death. Several plants expressing the genes retained viability as shown by their turgid appearance and maintenance of green color.

The second experiment compared a smaller number of independent transgenic lines for each gene but a greater number of progeny within each independent transformation event. This experiment confirmed the previous results. Those lines containing the specific SRP encoding yeast genes survived longer than the controls. In some cases the transgenic line survived more than 3 days after the controls had died.

According to the results of the first and second experiments some major lines containing the specific SRP encoding yeast genes were identified, which showed the best results with regard to the average days of survival after wild type and/or the hit percentage.

In a third experiment these major lines were tested with multiple replicates (4-80 plants per line). The average number of days the plants of the major line survived longer than wild-type was measured. I.e., the number '1' means that, on average, the plants overexpressing this ORF, on averaged survived 1 day longer than wild-type. The value for WT in this column is '0'. The results are summmarised in table 3.

TABLE 3

Drought tolerance of transgenic *Arabidopsis thaliana* expressing the various SRP encoding genes from *Saccharomyces cerevisiae* or *E. coli* after imposition of drought stress on 3 week old plants in a third experiment using several plants from one transgenic line (experiment 3).

| Sequ. ID No. | Gene | Average days of survival after WT |
|---|---|---|
| 1 | B0019 | 0.78 |
| 5 | B0730 | 1.13 |
| 9 | B1528 | 3.75 |
| 13 | B1829 | 1.73 |
| 17 | B2170 | 0.7 |
| 21 | B3164 | 3.14 |
| 25 | YBL002W | 2.5 |
| 29 | YBR002C | 1.3 |
| 33 | YBR010W | 1.2 |
| 37 | YBR090c | 0.8 |
| 41 | YBR109C | 1.88 |
| 45 | YBR288C | 1.8 |
| 49 | YCR087W | 7.53 |
| 53 | YEL001C | 2.33 |
| 57 | YER062c | 3 |
| 61 | YER145C | 1.45 |
| 65 | YER146W | 3.29 |
| 69 | YGL151W | 0.7 |
| 73 | YGR046W | 1.08 |
| 77 | YGR060W | 1.6 |
| 81 | YGR141W | 0.58 |
| 85 | YHR214W-A | 0.7 |
| 89 | YIL002C | 1.85 |
| 93 | YIL031W | 0.79 |
| 97 | YIL076W | 0.8 |
| 101 | YIL077C | 4.86 |
| 105 | YIL121W | 1.3 |
| 109 | YIL156W | 1.1 |
| 113 | YJR044C | 1.33 |
| 117 | YKL057C | 2.2 |
| 121 | YKL150W | 1.17 |
| 125 | YKR057W | 2.8 |
| 129 | YLR062c | 2.43 |
| 133 | YLR142W | 3.69 |
| 137 | YLR173W | 1.29 |
| 141 | YLR210W | 2.1 |
| 145 | YLR274W | 0.64 |
| 149 | YLR394W | 1.6 |
| 153 | YNL108C | 2.23 |
| 157 | YNL141W | 3.80 |
| 161 | YNL231C | 0.85 |
| 165 | YNL282W | 2.75 |
| 169 | YNL283C | 2.33 |
| 173 | YNL286W | 2.23 |
| 177 | YNR029C | 1.11 |
| 185 | YOR102W | 1.5 |
| 189 | YOR154W | 1.14 |
| 193 | YOR170W | 0.53 |
| 197 | YOR266W | 1.89 |
| 201 | YOR298C-A | 1.2 |
| 205 | YPL030W | 0.92 |
| 209 | YPL103C | 3.42 |
| 213 | YPL136W | 2 |
| 217 | YPL211W | 3.0 |

Drought tolerance is measured for the indicated number of transgenic plants (Plants tested) as the average number of days (Average days of survival after WT) that the transgenic plants survived after the control (untransformed wild type). For WT, this column has the value '0'.

In a further experiment, for individual major lines, other lines containing the same gene contruct, but resulting from a different transformation event were tested. In these lines, the specific SRP encoding yeast genes is incorporated at a different site in the plant genom. The results are summmarised in table 4 in accordance to table 3. The results demonstrate the dependence of, the stress tolerance and/or resistance in plants on the expression of the SRP, rather than the insertion event.

TABLE 4

Drought tolerance of transgenic *Arabidopsis thaliana* expressing selected SRP encoding genes from *Saccharomyces cerevisiae* or *E. coli* after imposition of drought stress on 3 week old plants in a third experiment using one plant from several independent transgenic lines each (experiment 3).

| Sequ. ID No. | Gene | Number other lines tested | Average days of survival after WT |
|---|---|---|---|
| 1 | B0019 | 4 | 1.5 |
| 5 | B0730 | 11 | 0.36 |
| 9 | B1528 | 3 | 2.33 |
| 13 | B1829 | 9 | 0.89 |
| 17 | B2170 | 11 | 0.6 |
| 21 | B3164 | 8 | 1.25 |
| 25 | YBL002W | 9 | 1 |
| 29 | YBR002C | 8 | 2.25 |
| 33 | YBR010W | 9 | 1 |
| 37 | YBR090c | 8 | 0.75 |
| 41 | YBR109C | 5 | 1.2 |
| 45 | YBR288C | 9 | 2.2 |
| 53 | YEL001C | 3 | 3 |
| 57 | YER062C | 4 | 2 |
| 61 | YER145C | 5 | 1.6 |
| 65 | YER146W | 4 | 3.25 |
| 69 | YGL151W | 9 | 0.6 |
| 77 | YGR060W | 7 | 2.7 |
| 81 | YGR141W | 9 | 0.33 |
| 85 | YHR214W-A | 8 | 2.5 |
| 89 | YIL002C | 9 | 0.44 |
| 93 | YIL031W | 9 | 0.44 |
| 97 | YIL076W | 6 | 0.2 |
| 101 | YIL077C | 9 | 1.44 |
| 105 | YIL121W | 7 | 1.7 |
| 109 | YIL156W | 9 | 1.8 |
| 113 | YJR044C | 6 | 1.33 |
| 117 | YKL057C | 7 | 0.86 |
| 121 | YKL150W | 8 | 0.5 |
| 125 | YKR057W | 2.8 | |
| 129 | YLR062c | 3 | 3.67 |
| 133 | YLR142W | 8 | 2 |
| 137 | YLR173W | 9 | 0.56 |
| 141 | YLR210W | 8 | 2.0 |
| 145 | YLR274W | 8 | 1.5 |
| 149 | YLR394W | 7 | 0.7 |
| 153 | YNL108C | 7 | 1.57 |
| 157 | YNL141W | 8 | 2.13 |
| 161 | YNL231C | 9 | 0.89 |
| 165 | YNL282W | 6 | 1.8 |
| 169 | YNL283C | 7 | 1.43 |
| 173 | YNL286W | 7 | 0.86 |
| 177 | YNR029C | 7 | 1 |
| 181 | YOL056W | 8 | 2.5 |
| 185 | YOR102W | 6 | 2.17 |
| 189 | YOR154W | 8 | 1.38 |
| 193 | YOR170W | 9 | 1.11 |
| 197 | YOR266W | 2 | 4.0 |
| 201 | YOR298C-A | 7 | 0.57 |
| 205 | YPL030W | 6 | 0.83 |
| 209 | YPL103C | 5 | 3.8 |
| 213 | YPL211W | 4 | 2.5 |

Drought tolerance is measured for the indicated number of transgenic plants (Plants tested) as the average number of days (Average days of survival after WT) that the transgenic plants survived after the control (untransformed wild type). For WT, this column has the value '0'.

Chlorophyll fluorescence measurements of photosynthetic yield confirmed that severe drought stress completely inhibited photosynthesis in the control plants, but the transgenic major lines maintained photosynthetic function longer (Table 5).

TABLE 5

Drought tolerance of transgenic *Arabidopsis thaliana* expressing the various SRP encoding genes from *Saccharomyces cerevisiae* or *E. coli* after imposition of drought stress on 3 week old plants in a third experiment using several plants from one transgenic line (experiment 3). Drought tolerance is reported as photosynthetic yield measured by chlorophyll fluorescence measured at three different time point during the drought stress experiment, and compared to the untransformed wild type control. For each transgenic line, the average of 5 replicate plants is indicated, the wild type value is the average of 20-25 plants measured in the same experiment.

| Sequ. ID No. | Gene | Photosynthetic yield 6 days after final watering | wild type | Photosynthetic yield 10 days after final watering | wild type | Photosynthetic yield 14 days after final watering | wild type |
|---|---|---|---|---|---|---|---|
| 5 | B0730 | 775 | 779 | 438 | 76 | | |
| 9 | B1528 | 762 | 779 | 747 | 76 | | |
| 13 | B1829 | 758 | 779 | 669 | 76 | | |
| 17 | B2170 | 772 | 779 | 549 | 76 | | |
| 21 | B3164 | 755 | 768 | 620 | 272 | | |
| 25 | YBL002W | 750 | 736 | 758 | 709 | 241 | 20 |
| 29 | YBR002C | 744 | 750 | 761 | 576 | 136 | 31 |
| 33 | YBR010W | 743 | 750 | 597 | 576 | 65 | 31 |
| 37 | YBR090c | 755 | 768 | 392 | 272 | | |
| 41 | YBR109C | 774 | 785 | 780 | 272 | | |
| 45 | YBR288C | 759 | 760 | 724 | 549 | 221 | 20 |
| 49 | YCR087W | 746 | 750 | 756 | 576 | 599 | 31 |
| 53 | YEL001C | 744 | 736 | 771 | 709 | 398 | 20 |
| 57 | YER062c | 752 | 768 | 784 | 272 | | |
| 61 | YER145C | 762 | 768 | 611 | 272 | | |
| 65 | YER146W | 758 | 768 | 773 | 272 | | |
| 69 | YGL151W | 757 | 736 | 609 | 709 | 0 | 20 |
| 73 | YGR046W | 762 | 766 | 740 | 654 | 43 | 106 |
| 77 | YGR060W | | | 779 | 610 | 131 | 16 |
| 81 | YGR141W | 766 | 766 | 764 | 654 | 112 | 106 |
| 85 | YHR214W-A | | | 740 | 610 | 0 | 16 |
| 89 | YIL002C | 785 | 785 | | | | |
| 93 | YIL031W | 757 | 736 | 683 | 709 | | |
| 97 | YIL076W | 772 | 766 | 693 | 654 | | |
| 101 | YIL077C | 814 | 785 | | | | |
| 105 | YIL121W | 765 | 766 | 750 | 654 | | |
| 109 | YIL156W | 770 | 766 | 753 | 654 | 139 | 106 |
| 113 | YJR044C | 756 | 766 | 753 | 654 | 708 | 107 |
| 117 | YKL057C | 775 | 766 | 728 | 547 | | |
| 121 | YKL150W | 760 | 736 | 607 | 709 | 147 | 106 |
| 125 | YKR057W | 781 | 785 | 777 | 751 | 453 | 169 |
| 129 | YLR062c | 748 | 768 | 751 | 272 | | |
| 133 | YLR142W | 745 | 736 | 790 | 709 | 580 | 106 |
| 137 | YLR173W | 745 | 736 | 757 | 709 | 137 | 106 |
| 141 | YLR210W | 740 | 736 | 777 | 709 | 137 | 106 |
| 145 | YLR274W | 761 | 736 | 61 | 20 | | |
| 149 | YLR394W | | | 786 | 610 | 143 | 16 |
| 153 | YNL108C | 762 | 766 | 755 | 654 | 138 | 107 |
| 157 | YNL231C | 766 | 766 | 703 | 654 | | |
| 165 | YNL282W | 751 | 736 | 739 | 709 | 214 | 106 |
| 169 | YNL283C | 761 | 766 | 765 | 654 | 288 | 106 |
| 173 | YNL286W | 768 | 766 | 610 | 209 | 142 | 106 |
| 177 | YNR029C | 753 | 766 | 762 | 654 | 307 | 106 |
| 181 | YOL056W | 752 | 736 | 728 | 709 | 584 | 20 |
| 185 | YOR102W | 751 | 736 | | | 284 | 20 |
| 189 | YOR154W | 761 | 736 | 781 | 710 | 141 | 20 |
| 193 | YOR170W | 754 | 779 | 629 | 76 | | |
| 201 | YOR298C-A | 768 | 766 | 737 | 548 | | |
| 205 | YPL030W | 767 | 766 | 452 | 548 | | |
| 213 | YPL136W | 794 | 766 | 293 | 548 | | |
| 217 | YPL211W | 764 | 768 | 783 | 272 | | |

EXAMPLE 2

Engineering Stress-Tolerant *Arabidopsis* Plants by Over-Expressing Stress Related Protein Encoding Genes from *Saccharomyces* cereviesae or *E. coli* Using Stress-Inducible and Tissue-Specific Promoters Transgenic *Arabidopsis* plants were created as in example 1 to express the stress related protein encoding transgenes under the control of either a tissue-specific or stress-inducible promoter. Constitutive expression of a transgene may cause deleterious side effects. Stress inducible expression was achieved using promoters selected from those listed above in Table 1.

T2 generation plants were produced and treated with drought stress in two experiments. For the first drought experiment, the plants were deprived of water until the plant and soil were desiccated. At various times after withholding water, a normal watering schedule was resumed and the plants were grown to maturity. Seed yield was determined as seeds per plant. At an equivalent degree of drought stress, tolerant plants were able to resume normal growth and produced more seeds than non-transgenic control plants. Proline content of the leaves and stomatal aperture were also measured at various times during the drought stress. Tolerant plants maintained a lower proline content and a greater stomatal aperture than the non-transgenic control plants.

An alternative method to impose water stress on the transgenic plants was by treatment with water containing an osmolyte such as polyethylene glycol (PEG) at specific water potential. Since PEG may be toxic, the plants were given only a short term exposure and then normal watering was resumed. As above, seed yields were measured from the mature plants. The response was measured during the stress period by physical measurements, such as stomatal aperture or osmotic potential, or biochemical measurements, such as accumulation of proline. Tolerant plants had higher seed yields, maintained their stomatal aperture and showed only slight changes in osmotic potential and proline levels, whereas the susceptible non-transgenic control plants closed their stomata and exhibited increased osmotic potential and proline levels.

The transgenic plants with a constitutive promoter controlling transcription of the transgene were compared to those plants with a drought-inducible promoter in the absence of stress. The results indicated that the metabolite and gene expression changes did not occur when plants with the stress-inducible promoter were grown in the absence of stress. These plants also had higher seed yields than those with the constitutive promoter.

EXAMPLE 3

Over-Expression of Stress Related Genes from *Saccharomyces cerevisiae* or *E. coli* Provides Tolerance of Multiple Abiotic Stresses Plants that exhibit tolerance of one abiotic stress often exhibit tolerance of another environmental stress or an oxygen free radical generating herbicide. This phenomenon of cross-tolerance is not understood at a mechanistic level (McKersie and Leshem, 1994). Nonetheless, it is reasonable to expect that plants exhibiting enhanced drought tolerance due to the expression of a transgene might also exhibit tolerance of low temperatures, freezing, salt, air pollutants such as ozone, and other abiotic stresses. In support of this hypothesis, the expression of several genes are up or down-regulated by multiple abiotic stress factors including cold, salt, osmoticum, ABA, etc (e.g. Hong et al. (1992) Developmental and organ-specific expression of an ABA- and stress-induced protein in barley. Plant Mol Biol 18: 663-674; Jagendorf and Takabe (2001) Inducers of glycinebetaine synthesis in barley. Plant Physiol 127: 1827-1835); Mizoguchi et al. (1996) A gene encoding a mitogen-activated protein kinase is induced simultaneously with genes for a mitogen-activated protein kinase and an S6 ribosomal protein kinase by touch, cold, and water stress in *Arabidopsis thaliana*. Proc Natl Acad Sci USA 93: 765-769; Zhu (2001) Cell signaling under salt, water and cold stresses. Curr Opin Plant Biol 4: 401-406).

To determine salt tolerance, seeds of *Arabidopsis thaliana* were sterilized (100% bleach, 0.1% TritonX for five minutes two times and rinsed five times with ddH2O). Seeds were plated on non-selection media (½ MS, 0.6% phytagar, 0.5 g/L MES, 1% sucrose, 2 µg/ml benamyl). Seeds are allowed to germinate for approximately ten days. At the 4-5 leaf stage, transgenic plants were potted into 5.5 cm diameter pots and allowed to grow (22° C., continuous light) for approximately seven days, watering as needed. To begin the assay, two liters of 100 mM NaCl and ⅛ MS was added to the tray under the pots. To the tray containing the control plants, three liters of ⅛ MS was added. The concentrations of NaCl supplementation were increased stepwise by 50 mM every 4 days up to 200 mM. After the salt treatment with 200 mM, fresh and dry weights of the plants as well as seed yields were determined.

To determine cold tolerance, seeds of the transgenic and cold lines were germinated and grown for approximately 10 days to the 4-5 leaf stage as above. The plants were then transferred to cold temperatures (5° C.) and grown through the flowering and seed set stages of development. Photosynthesis was measured using chlorophyll fluorescence as an indicator of photosynthetic fitness and integrity of the photosystems. Seed yield and plant dry weight were measured as an indictor of plant biomass production.

Plants that had tolerance to salinity or cold had higher seed yields, photosynthesis and dry matter production than susceptible plants.

EXAMPLE 4

Engineering Stress-Tolerant Alfalfa Plants by Over-Expressing Stress Related Genes from *Saccharomyces cerevisiae* or *E. coli*

A regenerating clone of alfalfa (*Medicago sativa*) was transformed using the method of (McKersie et al., 1999 Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown DCW and A Atanassov (1985. Plant Cell Tissue Organ Culture 4: 111-112). Alternatively, the RA3 variety (University of Wisconsin) has been selected for use in tissue culture (Walker et al., 1978 µm J Bot 65:654-659).

Petiole explants were cocultivated with an overnight culture of *Agrobacterium tumefaciens* C58C1 pMP90 (McKersie et al., 1999 Plant Physiol 119: 839-847) or LBA4404 containing a binary vector. Many different binary vector systems have been described for plant transformation (e.g. An, G. in *Agrobacterium* Protocols. Methods in Molecular Biology vol 44, pp 47-62, Gartland K M A and M R Davey eds. Humana Press, Totowa, N.J.). Many are based on the vector pBIN19 described by Bevan (Nucleic Acid Research. 1984.

12:8711-8721) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,767,366 and 6,225,105). Similarly, various promoters can be used to regulate the trait gene that provides constitutive, developmental, tissue or environmental regulation of gene transcription. In this example, the 34S promoter (GenBank Accession numbers M59930 and X16673) was used to provide constitutive expression of the trait gene.

The explants were cocultivated for 3 d in the dark on SH induction medium containing 288 mg/L Pro, 53 mg/L thioproline, 4.35 g/L K2SO4, and 100 μm acetosyringinone. The explants were washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos were transferred to BOi2Y development medium containing no growth regulators, no antibiotics, and 50 g/L sucrose. Somatic embryos were subsequently germinated on half-strength Murashige-Skoog medium. Rooted seedlings were transplanted into pots and grown in a greenhouse.

The T0 transgenic plants were propagated by node cuttings and rooted in Turface growth medium. The plants were defoliated and grown to a height of about 10 cm (approximately 2 weeks after defoliation). The plants were then subjected to drought stress in two experiments.

For the first drought experiment, the seedlings received no water for a period up to 3 weeks at which time the plant and soil were desiccated. At various times after withholding water, a normal watering schedule was resumed. At one week after resuming watering, the fresh and dry weights of the shoots was determined. At an equivalent degree of drought stress, tolerant plants were able to resume normal growth whereas susceptible plants had died or suffered significant injury resulting in less dry matter. Proline content of the leaves and stomatal aperture were also measured at various times during the drought stress. Tolerant plants maintained a lower proline content and a greater stomatal aperture than the non-transgenic control plants.

An alternative method to impose water stress on the transgenic plants was by treatment with a solution at specific water potential, containing an osmolyte such as polyethylene glycol (PEG). The PEG treatment was given to either detached leaves (e.g. Djilianov et al., 1997 Plant Science 129: 147-156) or to the roots (Wakabayashi et al., 1997 Plant Physiol 113: 967-973). Since PEG may be toxic, the plants were given only a short term exposure. The response was measured as physical measurements such as stomatal aperture or osmotic potential, or biochemical measurements such as accumulation of proline. Tolerant plants maintained their stomatal aperture and showed only slight changes in osmotic potential, whereas the susceptible non-transgenic control plants closed their stomata and exhibited increased osmotic potential. In addition the changes in proline and other metabolites were less in the tolerant transgenic plants than in the non-transgenic control plants.

Tolerance of salinity and cold were measured using methods as described in example 3. Plants that had tolerance to salinity or cold had higher seed yields, photosynthesis and dry matter production than susceptible plants.

EXAMPLE 5

Engineering Stress-Tolerant Ryegrass Plants by Over-Expressing Stress Related Genes from *Saccharomyces cerevisiae* or *E. coli*

Seeds of several different ryegrass varieties may be used as explant sources for transformation, including the commercial variety Gunne available from Svalof Weibull seed company or the variety Affinity. Seeds were surface-sterilized sequentially with 1% Tween-20 for 1 minute, 100% bleach for 60 minutes, 3 rinses with 5 minutes each with de-ionized and distilled H2O, and then germinated for 3-4 days on moist, sterile filter paper in the dark. Seedlings were further sterilized for 1 minute with 1% Tween-20, 5 minutes with 75% bleach, and rinsed 3 times with ddH2O, 5 min each.

Surface-sterilized seeds were placed on the callus induction medium containing Murashige and Skoog basal salts and vitamins, 20 sucrose, 150 mg/l asparagine, 500 mg/l casein hydrolysate, 3 g/l Phytagel, 10 mg/l BAP, and 5 mg/l dicamba. Plates were incubated in the dark at 25 C for 4 weeks for seed germination and embryogenic callus induction.

After 4 weeks on the callus induction medium, the shoots and roots of the seedlings were trimmed away, the callus was transferred to fresh media, maintained in culture for another 4 weeks, and then transferred to MSO medium in light for 2 weeks. Several pieces of callus (11-17 weeks old) were either strained through a 10 mesh sieve and put onto callus induction medium, or cultured in 100 ml of liquid ryegrass callus induction media (same medium as for callus induction with agar) in a 250 ml flask. The flask was wrapped in foil and shaken at 175 rpm in the dark at 23 C for 1 week. Sieving the liquid culture with a 40-mesh sieve collected the cells. The fraction collected on the sieve was plated and cultured on solid ryegrass callus induction medium for 1 week in the dark at 25 C. The callus was then transferred to and cultured on MS medium containing 1% sucrose for 2 weeks.

Transformation can be accomplished with either *Agrobacterium* of with particle bombardment methods. An expression vector is created containing a constitutive plant promoter and the cDNA of the gene in a pUC vector. The plasmid DNA was prepared from *E. coli* cells using with Qiagen kit according to manufacturer's instruction. Approximately 2 g of embryogenic callus was spread in the center of a sterile filter paper in a Petri dish. An aliquot of liquid MSO with 10 g/l sucrose was added to the filter paper. Gold particles (1.0 μm in size) were coated with plasmid DNA according to method of Sanford et al., 1993 and delivered to the embryogenic callus with the following parameters: 500 μg particles and 2 μg DNA per shot, 1300 psi and a target distance of 8.5 cm from stopping plate to plate of callus and 1 shot per plate of callus.

After the bombardment, calli were transferred back to the fresh callus development medium and maintained in the dark at room temperature for a 1-week period. The callus was then transferred to growth conditions in the light at 25° C. to initiate embryo differentiation with the appropriate selection agent, e.g. 250 nM Arsenal, 5 mg/l PPT or 50 mg/L kanamycin. Shoots resistant to the selection agent appeared and once rotted were transferred to soil.

Samples of the primary transgenic plants (T0) are analyzed by PCR to confirm the presence of T-DNA. These results are confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

Transgenic T0 ryegrass plants were propagated vegetatively by excising tillers. The transplanted tillers were maintained in the greenhouse for 2 months until well established. The shoots were defoliated and allowed to grow for 2 weeks.

The first drought experiment was conducted in a manner similar to that described in example 3. The seedlings received no water for a period up to 3 weeks at which time the plant and soil were desiccated. At various times after withholding water, a normal watering schedule was resumed. At one week after resuming watering, the lengths of leaf blades, and the fresh and dry weights of the shoots was determined. At an equivalent degree of drought stress, tolerant plants were able to resume normal growth whereas susceptible plants had died or suffered significant injury resulting in shorter leaves and less dry matter. Praline content of the leaves and stomatal aperture were also measured at various times during the drought stress. Tolerant plants maintained a lower proline content and a greater stomatal aperture than the non-transgenic control plants.

A second experiment imposing drought stress on the transgenic plants was by treatment with a solution of PEG as described in the previous examples. Tolerance of salinity and cold were measured using methods as described in example 3. Plants that had tolerance to salinity or cold had higher seed yields, photosynthesis and dry matter production than susceptible plants.

EXAMPLE 6

Engineering Stress-Tolerant Soybean Plants by Over-Expressing Stress Related Genes from *Saccharomyces cerevisiae* or *E. coli*

Soybean was transformed according to the following modification of the method described in the Texas A&M U.S. Pat. No. 5,164,310. Several commercial soybean varieties are amenable to transformation by this method. The cultivar Jack (available from the Illinois Seed Foundation) is a commonly used for transformation. Seeds were sterilized by immersion in 70% (v/v) ethanol for 6 min and in 25% commercial bleach (NaOCl) supplemented with 0.1% (v/v) Tween for 20 min, followed by rinsing 4 times with sterile double distilled water. Seven-day seedlings were propagated by removing the radicle, hypocotyl and one cotyledon from each seedling. Then, the epicotyl with one cotyledon was transferred to fresh germination media in petri dishes and incubated at 25° C. under a 16-hr photoperiod (approx. 100 µE-m-2s-1) for three weeks. Axillary nodes (approx. 4 mm in length) were cut from 3-4 week-old plants. Axillary nodes were excised and incubated in *Agrobacterium* LBA4404 culture.

Many different binary vector systems have been described for plant transformation (e.g. An, G. in *Agrobacterium* Protocols. Methods in Molecular Biology vol 44, pp 47-62, Gartland K M A and M R Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,767,3666 and 6,225,105). Similarly, various promoters can be used to regulate the trait gene to provide constitutive, developmental, tissue or environmental regulation of gene transcription. In this example, the 34S promoter (GenBank Accession numbers M59930 and X16673) was used to provide constitutive expression of the trait gene.

After the co-cultivation treatment, the explants were washed and transferred to selection media supplemented with 500 mg/L timentin. Shoots were excised and placed on a shoot elongation medium. Shoots longer than 1 cm were placed on rooting medium for two to four weeks prior to transplanting to soil.

The primary transgenic plants (T0) were analyzed by PCR to confirm the presence of T-DNA. These results were confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

Tolerant plants had higher seed yields, maintained their stomatal aperture and showed only slight changes in osmotic potential and proline levels, whereas the susceptible non-transgenic control plants closed their stomata and exhibited increased osmotic potential and proline levels.

Tolerance of drought, salinity and cold were measured using methods as described in example 3. Plants that had tolerance to salinity or cold had higher seed yields, photosynthesis and dry matter production than susceptible plants.

EXAMPLE 7

Engineering Stress-Tolerant Rapeseed/Canola Plants by Over-Expressing Stress Related Genes from *Saccharomyces cerevisiae* or *E. coli*

Cotyledonary petioles and hypocotyls of 5-6 day-old young seedlings were used as explants for tissue culture and transformed according to Babic et al. (1998, Plant Cell Rep 17: 183-188). The commercial cultivar Westar (Agriculture Canada) is the standard variety used for transformation, but other varieties can be used.

*Agrobacterium tumefaciens* LBA4404 containing a binary vector was used for canola transformation. Many different binary vector systems have been described for plant transformation (e.g. An, G. in *Agrobacterium* Protocols. Methods in Molecular Biology vol 44, pp 47-62, Gartland K M A and M R Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,767,366 and 6,225,105). Similarly, various promoters can be used to regulate the trait gene to provide constitutive, developmental, tissue or environmental regulation of gene transcription. In this example, the 34S promoter (GenBank Accession numbers M59930 and X16673) was used to provide constitutive expression of the trait gene.

Canola seeds were surface-sterilized in 70% ethanol for 2 min., and then in 30% Clorox with a drop of Tween-20 for 10 min, followed by three rinses with sterilized distilled water. Seeds were then germinated in vitro 5 days on half strength MS medium without hormones, 1% sucrose, 0.7% Phytagar at 23° C., 16 hr. light. The cotyledon petiole explants with the cotyledon attached were excised from the in vitro seedlings, and inoculated with *Agrobacterium* by dipping the cut end of the petiole explant into the bacterial suspension. The explants were then cultured for 2 days on MSBAP-3 medium containing 3 mg/l BAP, 3% sucrose, 0.7% Phytagar at 23° C., 16 hr light. After two days of co-cultivation with *Agrobacterium*, the petiole explants were transferred to MSBAP-3 medium containing 3 mg/l BAP, cefotaxime, carbenicillin, or timentin (300 mg/l) for 7 days, and then cultured on MSBAP-3 medium with cefotaxime, carbenicillin, or timentin and selection agent until shoot regeneration. When the shoots were 5-10 mm in length, they were cut and transferred to shoot elongation medium (MSBAP-0.5, containing 0.5 mg/l BAP). Shoots of about 2 cm in length were transferred to the rooting medium (MSO) for root induction.

Samples of the primary transgenic plants (T0) were analyzed by PCR to confirm the presence of T-DNA. These results were confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

The transgenic plants were then evaluated for their improved stress tolerance according to the method described in Example 3. Tolerant plants had higher seed yields, maintained their stomatal aperture and showed only slight changes in osmotic potential and proline levels, whereas the susceptible non-transgenic control plants closed their stomata and exhibited increased osmotic potential and proline levels.

Tolerance of drought, salinity and cold were measured using methods as described in the previous example 3. Plants that had tolerance to salinity or cold had higher seed yields, photosynthesis and dry matter production than susceptible plants.

EXAMPLE 8

Engineering Stress-Tolerant Corn Plants by Over-Expressing Stress Related Genes from *Saccharomyces cerevisiae* or *E. coli*

Transformation of maize (*Zea Mays* L.) is performed with a modification of the method described by Ishida et al. (1996. Nature Biotech 14745-50). Transformation is genotype-dependent in corn and only specific genotypes are amenable to transformation and regeneration. The inbred line A188 (University of Minnesota) or hybrids with A188 as a parent are good sources of donor material for transformation (Fromm et al. 1990 Biotech 8:833-839), but other genotypes can be used successfully as well. Ears are harvested from corn plants at approximately 11 days after pollination (DAP) when the length of immature embryos is about 1 to 1.2 mm. Immature embryos are co-cultivated with *Agrobacterium tumefaciens* that carry "super binary" vectors and transgenic plants are recovered through organogenesis. The super binary vector system of Japan Tobacco is described in WO patents WO94/00977 and WO95/06722. Vectors were constructed as described. Various selection marker genes can be used including the maize gene encoding a mutated acetohydroxy acid synthase (AHAS) enzyme (U.S. Pat. No. 6,025,541). Similarly, various promoters can be used to regulate the trait gene to provide constitutive, developmental, tissue or environmental regulation of gene transcription. In this example, the 34S promoter (GenBank Accession numbers M59930 and X16673) was used to provide constitutive expression of the trait gene.

Excised embryos are grown on callus induction medium, then maize regeneration medium, containing imidazolinone as a selection agent. The Petri plates are incubated in the light at 25° C. for 2-3 weeks, or until shoots develop. The green shoots are transferred from each embryo to maize rooting medium and incubated at 25° C. for 2-3 weeks, until roots develop. The rooted shoots are transplanted to soil in the greenhouse. T1 seeds are produced from plants that exhibit tolerance to the imidazolinone herbicides and which are PCR positive for the transgenes.

The T1 transgenic plants were then evaluated for their improved stress tolerance according to the method described in Example 3. The T1 generation of single locus insertions of the T-DNA will segregate for the transgene in a 3:1 ratio. Those progeny containing one or two copies of the transgene are tolerant of the imidazolinone herbicide, and exhibit greater tolerance of drought stress than those progeny lacking the transgenes. Tolerant plants had higher seed yields, maintained their stomatal aperture and showed only slight changes in osmotic potential and proline levels, whereas the susceptible non transgenic control plants closed their stomata and exhibited increased osmotic potential and proline levels. Homozygous T2 plants exhibited similar phenotypes. Hybrid plants (F1 progeny) of homozygous transgenic plants and non-transgenic plants also exhibited increased environmental stress tolerance.

Tolerance of salinity and cold were measured using methods as described in the previous example 3. Plants that had tolerance to drought, salinity or cold had higher seed yields, photosynthesis and dry matter production than susceptible plants.

EXAMPLE 9

Engineering Stress-Tolerant Wheat Plants by Over-Expressing Stress Related Genes from *Saccharomyces cerevisiae* or *E. coli*

Transformation of wheat is performed with the method described by Ishida et al. (1996 Nature Biotech. 14745-50). The cultivar Bobwhite (available from CYMMIT, Mexico) is commonly used in transformation. Immature embryos are co-cultivated with *Agrobacterium tumefaciens* that carry "super binary" vectors, and transgenic plants are recovered through organogenesis. The super binary vector system of Japan Tobacco is described in WO patents WO94/00977 and WO95/06722. Vectors were constructed as described. Various selection marker genes can be used including the maize gene encoding a mutated acetohydroxy acid synthase (AHAS) enzyme (U.S. Pat. No. 6,025,541). Similarly, various promoters can be used to regulate the trait gene to provide constitutive, developmental, tissue or environmental regulation of gene transcription. In this example, the 34S promoter (GenBank Accession numbers M59930 and X16673) was used to provide constitutive expression of the trait gene.

After incubation with *Agrobacterium*, the embryos are grown on callus induction medium, then regeneration medium, containing imidazolinone as a selection agent. The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the imidazolinone herbicides and which are PCR positive for the transgenes.

The T1 transgenic plants were then evaluated for their improved stress tolerance according to the method described in the previous example 3. The T1 generation of single locus insertions of the T-DNA will segregate for the transgene in a 3:1 ratio. Those progeny containing one or two copies of the transgene are tolerant of the imidazolinone herbicide, and exhibit greater tolerance of drought stress than those progeny lacking the transgenes. Tolerant plants had higher seed yields, maintained their stomatal aperture and showed only slight changes in osmotic potential and proline levels, whereas the susceptible non-transgenic control plants closed their stomata and exhibited increased osmotic potential and proline levels. Homozygous T2 plants exhibited similar phenotypes. Tolerance of salinity and cold were measured using methods as described in the previous examples. Plants that had tolerance to drought, salinity or cold had higher seed yields, photosynthesis and dry matter production than susceptible plants.

EXAMPLE 10

Identification of Identical and Heterologous Genes

Gene sequences can be used to identify identical or heterologous genes from cDNA or genomic libraries. Identical genes (e.g. full-length cDNA clones) can be isolated via nucleic acid hybridization using for example cDNA libraries. Depending on the abundance of the gene of interest, 100,000 up to 1,000,000 recombinant bacteriophages are plated and transferred to nylon membranes. After denaturation with alkali, DNA is immobilized on the membrane by e.g. UV cross linking. Hybridization is carried out at high stringency conditions. In aqueous solution, hybridization and washing is performed at an ionic strength of 1 M NaCl and a temperature of 68° C. Hybridization probes are generated by e.g. radioactive ($^{32}$P) nick transcription labeling (High Prime, Roche, Mannheim, Germany). Signals are detected by autoradiography.

Partially identical or heterologous genes that are related but not identical can be identified in a manner analogous to the above-described procedure using low stringency hybridization and washing conditions. For aqueous hybridization, the ionic strength is normally kept at 1 M NaCl while the temperature is progressively lowered from 68 to 42° C.

Isolation of gene sequences with homology (or sequence identity/similarity) only in a distinct domain of (for example 10-20 amino acids) can be carried out by using synthetic radio labeled oligonucleotide probes. Radiolabeled oligonucleotides are prepared by phosphorylation of the 5-prime end of two complementary oligonucleotides with T4 polynucleotide kinase. The complementary oligonucleotides are annealed and ligated to form concatemers. The double stranded concatemers are than radiolabeled by, for example, nick transcription. Hybridization is normally performed at low stringency conditions using high oligonucleotide concentrations.

Oligonucleotide hybridization solution:
6×SSC
0.01 M sodium phosphate
1 mM EDTA (pH 8)
0.5% SDS
100 µg/ml denatured salmon sperm DNA
0.1% nonfat dried milk During hybridization, temperature is lowered stepwise to 5-10° C. below the estimated oligonucleotide $T_m$ or down to room temperature followed by washing steps and autoradiography. Washing is performed with low stringency such as 3 washing steps using 4×SSC. Further details are described by Sambrook, J. et al, 1989, "Molecular Cloning: A Laboratory Manual," Cold Spring Harbor Laboratory Press or Ausubel, F. M. et al., 1994, "Current Protocols in Molecular Biology," John Wiley & Sons.

EXAMPLE 11

Identification of Identical Genes by Screening Expression Libraries with Antibodies c-DNA clones can be used to produce recombinant polypeptide for example in *E. coli* (e.g. Qiagen QIAexpress pQE system). Recombinant polypeptides are then normally affinity purified via Ni-NTA affinity chromatography (Qiagen). Recombinant polypeptides are then used to produce specific antibodies for example by using standard techniques for rabbit immunization. Antibodies are affinity purified using a Ni-NTA column saturated with the recombinant antigen as described by Gu et al., 1994, BioTechniques 17:257-262. The antibody can than be used to screen expression cDNA libraries to identify identical or heterologous genes via an immunological screening (Sambrook, J. et al., 1989, "Molecular Cloning: A Laboratory Manual," Cold Spring Harbor Laboratory Press or Ausubel, F. M. et al., 1994, "Current Protocols in Molecular Biology", John Wiley & Sons).

EXAMPLE 12

In Vivo Mutagenesis

In vivo mutagenesis of microorganisms can be performed by passage of plasmid (or other vector) DNA through *E. coli* or other microorganisms (e.g. *Bacillus* spp. or yeasts such as *Saccharomyces cerevisiae*) which are impaired in their capabilities to maintain the integrity of their genetic information. Typical mutator strains have mutations in the genes for the DNA repair system (e.g., mutHLS, mutD, mutT, etc.; for reference, see Rupp, W. D., 1996, DNA repair mechanisms, in: *Escherichia coli* and *Salmonella*, p. 2277-2294, ASM: Washington.) Such strains are well known to those skilled in the art. The use of such strains is illustrated, for example, in Greener, A. and Callahan, M., 1994, Strategies 7: 32-34. Transfer of mutated DNA molecules into plants is preferably done after selection and testing in microorganisms. Transgenic plants are generated according to various examples within the exemplification of this document.

EXAMPLE 13

Engineering Stress-Tolerant *Arabidopsis* Plants by Over-Expressing Stress Related Protein Encoding Genes from *Brassica napus, Glycine max, Zea mays* or *Oryza sativa* Using Stress-Inducible and Tissue-Specific Promoters Transgenic *Arabidopsis* plants over-expressing stress related protein encoding genes from *Brassica napus, Glycine max, Zea mays* and *Oryza sativa* are created as described in example 1 to express the stress related protein encoding transgenes under the control of either a tissue-specific or stress-inducible promoter. Constitutive expression of a transgene may cause deleterious side effects, which can be avoided by the use of these promoters. Stress inducible expression is achieved using promoters selected from those listed above in Table 1.

T2 generation plants are produced and treated with drought stress in two experiments. For the first drought experiment, the plants are deprived of water until the plant and soil are desiccated. At various times after withholding water, a normal watering schedule is resumed and the plants are grown to maturity. Seed yield is determined as seeds per plant. At an equivalent degree of drought stress, tolerant plants are able to resume normal growth and produced more seeds than non-transgenic control plants. Proline content of the leaves and stomatal aperture is also measured at various times during the drought stress. Tolerant plants maintain a lower proline content and a greater stomatal aperture than the non-transgenic control plants.

An alternative method to impose water stress on the transgenic plantsis by treatment with water containing an osmolyte such as polyethylene glycol (PEG) at specific water potential. Since PEG can be toxic, the plants are given only a short term exposure and then normal watering was resumed. As above, seed yields are measured from the mature plants. The response is measured during the stress period by physical measurements, such as stomatal aperture or osmotic potential, or biochemical measurements, such as accumulation of proline. Tolerant plants have higher seed yields, maintain their stomatal aperture and show only slight changes in osmotic potential and proline levels, whereas the susceptible non-transgenic control plants close their stomata and exhibit increased osmotic potential and proline levels.

The transgenic plants with a constitutive promoter controlling transcription of the transgene are compared to those plants with a drought-inducible promoter in the absence of stress. The results indicate that the metabolite and gene expression changes do not occur when plants with the stress-inducible promoter were grown in the absence of stress. These plants also have higher seed yields than those with the constitutive promoter.

EXAMPLE 14

Over-Expression of Stress Related Genes from *Brassica napus, Glycine max, Zea mays* or *Oryza sativa* Provides Tolerance of Multiple Abiotic Stresses Plants that exhibit tolerance of one abiotic stress often exhibit tolerance of another environmental stress or an oxygen free radical generating herbicide. This phenomenon of cross-tolerance is not understood at a mechanistic level (McKersie and Leshem, 1994). Nonetheless, it is reasonable to expect that plants exhibiting enhanced drought tolerance due to the expression of a transgene might also exhibit tolerance of low temperatures, freezing, salt, air pollutants such as ozone, and other abiotic stresses. In support of this hypothesis, the expression of several genes are up or down-regulated by multiple abiotic stress factors including cold, salt, osmoticum, ABA, etc (e.g. Hong et al. (1992) Developmental and organ-specific expression of an ABA- and stress-induced protein in barley. Plant Mol Biol 18: 663-674; Jagendorf and Takabe (2001) Inducers of glycinebetaine synthesis in barley. Plant Physiol 127: 1827-1835); Mizoguchi et al. (1996) A gene encoding a mitogen-activated protein kinase is induced simultaneously with genes for a mitogen-activated protein kinase and an S6 ribosomal protein kinase by touch, cold, and water stress in *Arabidopsis thaliana*. Proc Natl Acad Sci USA 93: 765-769; Zhu (2001) Cell signaling under salt, water and cold stresses. Curr Opin Plant Biol 4: 401-406).

Transgenic *Arabidopsis* plants over-expressing stress related protein encoding genes from *Brassica napus, Glycine max, Zea mays* and *Oryza sativa* are created as described in example 1 and tested for tolerance to salt and cold stress.

To determine salt tolerance, seeds of *Arabidopsis thaliana* are sterilized (incubated in 100% bleach, 0.1% TritonX100 for five minutes (twice) and rinsed five times with ddH2O). Seeds are plated on non-selective medium (½ MS, 0.6% phytagar, 0.5 g/L MES, 1% sucrose, 2 µg/ml benamyl). Seeds are allowed to germinate for approximately ten days. At the 4-5 leaf stage, transgenic plants are potted into 5.5 cm diameter pots and allowed to grow (22° C., continuous light) for approximately seven days, watering as needed. To begin the assay, two liters of 100 mM NaCl and ⅛ MS are added to the tray under the pots. To the tray containing the control plants, three liters of ⅛ MS is added. The concentrations of NaCl supplementation are increased stepwise by 50 mM every 4 days up to 200 mM. After the salt treatment with 200 mM, fresh and dry weights of the plants as well as seed yields are determined. Transgenic plants overexpression stress related protein encoding genes from *Brassica napus, Glycine max, Zea mays* and *Oryza sativa* show higher fresh and dry weights and more seed yield in comparison to wildtype or mock transformed plants.

To determine cold tolerance, seeds of the transgenic and cold lines are germinated and grown for approximately 10 days to the 4-5 leaf stage as above. The plants are then transferred to cold temperatures (5° C.) and grown through the flowering and seed set stages of development. Photosynthesis is measured using chlorophyll fluorescence as an indicator of photosynthetic fitness and integrity of the photosystems. Seed yield and plant dry weight are measured as an indictor of plant biomass production.

It is found that the over-expression of stress related genes from *Brassica napus, Glycine max, Zea mays* or *Oryza sativa* provided tolerance to salt and cold as well as drought Plants that have tolerance to salinity or cold also have higher seed yields, photosynthesis and dry matter production than susceptible plants.

EXAMPLE 15

Engineering Stress-Tolerant Alfalfa Plants by Over-Expressing Stress Related Genes from *Brassica napus, Glycine max, Zea mays* or *Oryza sativa*

A regenerating clone of alfalfa (*Medicago sativa*) is transformed using the method of McKersie et al., 1999 (Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown and Atanassov (1985. Plant Cell Tissue Organ Culture 4: 111-112). Alternatively, the RA3 variety (University of Wisconsin) has been selected for use in tissue culture (Walker et al., 1978 µm J Bot 65:654-659).

Petiole explants are cocultivated with an overnight culture of *Agrobacterium tumefaciens* C58C1 pMP90 (McKersie et al., 1999 Plant Physiol 119: 839-847) or LBA4404 containing a binary vector. Many different binary vector systems have been described for plant transformation (e.g. An, G. in *Agrobacterium* Protocols. Methods in Molecular Biology vol 44, pp 47-62, Gartland K M A and M R Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,767,3666 and 6,225,105). Similarly, various promoters can be used to regulate the trait gene that provides constitutive, developmental, tissue or environmental regulation of gene transcription. In this example, the 34S promoter (GenBank Accession numbers M59930 and X16673) was used to provide constitutive expression of the trait gene.

The explants are cocultivated for 3 d in the dark on SH induction medium containing 288 mg/L Pro, 53 mg/L thioproline, 4.35 g/L K2SO4, and 100 μm acetosyringinone. The explants were washed in half-strength Murashige-Skoog medium (Murashige and Skoog, 1962) and plated on the same SH induction medium without acetosyringinone but with a suitable selection agent and suitable antibiotic to inhibit *Agrobacterium* growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings are transplanted into pots and grown in a greenhouse.

The T0 transgenic plants are propagated by node cuttings and rooted in Turface growth medium. The plants are defoliated and grown to a height of about 10 cm (approximately 2 weeks after defoliation). The plants are then subjected to drought stress in two experiments.

For the first drought experiment, the seedlings receive no water for a period up to 3 weeks at which time the plant and soil are desiccated. At various times after withholding water, a normal watering schedule is resumed. At one week after resuming watering, the fresh and dry weights of the shoots are determined. At an equivalent degree of drought stress, the tolerant transgenic plants are able to resume normal growth whereas susceptible wildtype plants have died or suffer significant injury resulting in less dry matter. Proline content of the leaves and stomatal aperture are also measured at various times during the drought stress. Tolerant transgenic plants maintain a lower proline content and a greater stomatal aperture than the non-transgenic control plants.

An alternative method to impose water stress on the transgenic plants is by treatment with a solution at specific water potential, containing an osmolyte such as polyethylene glycol (PEG). The PEG treatment is given to either detached leaves (e.g. Djilianov et al., 1997 Plant Science 129: 147-156) or to the roots (Wakabayashi et al., 1997 Plant Physiol 113: 967-973). Since PEG can be toxic, the plants are given only a short term exposure. The response is measured as physical measurements such as stomatal aperture or osmotic potential, or biochemical measurements such as accumulation of proline. Tolerant plants maintain their stomatal aperture and show only slight changes in osmotic potential, whereas the susceptible non-transgenic control plants close their stomata and exhibit increased osmotic potential. In addition the changes in proline and other metabolites are less in the tolerant transgenic plants than in the non-transgenic control plants.

Tolerance of salinity and cold is measured using methods as described in example 3. It is found that alfalfa plants over-expressing stress related genes from *Brassica napus, Glycine max, Zea mays* or *Oryza sativa* are more resistant to salinity and cold stress than non-transgenic control plants. Plants that have tolerance to salinity or cold also have higher seed yields, photosynthesis and dry matter production than susceptible plants.

EXAMPLE 16

Engineering Stress-Tolerant Ryegrass Plants by Over-Expressing Stress Related Genes from *Brassica napus, Glycine max, Zea mays* or *Oryza sativa*

Seeds of several different ryegrass varieties, may be used as explant sources for transformation, including the commercial variety Gunne available from Svalof Weibull seed company or the variety Affinity. Seeds are surface-sterilized sequentially with 1% Tween-20 for 1 minute, 100% bleach for 60 minutes, 3 rinses with 5 minutes each with de-ionized and distilled H2O, and then germinated for 3-4 days on moist, sterile filter paper in the dark. Seedlings are further sterilized for 1 minute with 1% Tween-20, 5 minutes with 75% bleach, and rinsed 3 times with ddH2O, 5 min each.

Surface-sterilized seeds are placed on the callus induction medium containing Murashige and Skoog basal salts and vitamins, 20 g/l sucrose, 150 mg/l asparagine, 500 mg/l casein hydrolysate, 3 g/l Phytagel, 10 mg/l BAP, and 5 mg/l dicamba. Plates are incubated in the dark at 25 C for 4 weeks for seed germination and embryogenic callus induction.

After 4 weeks on the callus induction medium, the shoots and roots of the seedlings are trimmed away, the callus is transferred to fresh media, maintained in culture for another 4 weeks, and then transferred to MSO medium in light for 2 weeks. Several pieces of callus (11-17 weeks old) are either strained through a 10 mesh sieve and put onto callus induction medium, or cultured in 100 ml of liquid ryegrass callus induction media (same medium as for callus induction with agar) in a 250 ml flask. The flask is wrapped in foil and shaken at 175 rpm in the dark at 23° C. for 1 week. Sieving the liquid culture with a 40-mesh sieve collect the cells. The fraction collected on the sieve is plated and cultured on solid ryegrass callus induction medium for 1 week in the dark at 25 C. The callus is then transferred to and cultured on MS medium containing 1% sucrose for 2 weeks.

Transformation can be accomplished with either *Agrobacterium* of with particle bombardment methods. An expression vector is created containing a constitutive plant promoter and the cDNA of the gene in a pUC vector. The plasmid DNA is prepared from *E. coli* cells using with Qiagen kit according to manufacturer's instruction. Approximately 2 g of embryogenic callus is spread in the center of a sterile fitter paper in a Petri dish. An aliquot of liquid MSO with 10 g/l sucrose is added to the filter paper. Gold particles (1.0 μm in size) are coated with plasmid DNA according to method of Sanford et al., 1993 and delivered to the embryogenic callus with the following parameters: 500 μg particles and 2 μg DNA per shot, 1300 psi and a target distance of 8.5 cm from stopping plate to plate of callus and 1 shot per plate of callus.

After the bombardment, calli are transferred back to the fresh callus development medium and maintained in the dark at room temperature for a 1-week period. The callus is then transferred to growth conditions in the light at 25° C. to initiate embryo differentiation with the appropriate selection agent, e.g. 250 nM Arsenal, 5 mg/l PPT or 50 mg/L kanamycin. Shoots resistant to the selection agent appeared and once rooted?? are transferred to soil.

Samples of the primary transgenic plants (T0) are analyzed by PCR to confirm the presence of T-DNA. These results are confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

Transgenic T0 ryegrass plants are propagated vegetatively by excising tillers. The transplanted tillers are maintained in the greenhouse for 2 months until well established. The shoots are defoliated and allowed to grow for 2 weeks.

The first drought experiment is conducted in a manner similar to that described in example 3. The seedlings receive no water for a period up to 3 weeks at which time the plant and soil are desiccated. At various times after withholding water, a normal watering schedule is resumed. At one week after resuming watering, the lengths of leaf blades, and the fresh and dry weights of the shoots is determined. At an equivalent degree of drought stress, tolerant plants are able to resume normal growth whereas susceptible plants have died or suffer significant injury resulting in shorter leaves and less dry matter. Proline content of the leaves and stomatal aperture are also measured at various times during the drought stress. Tolerant plants maintain a lower proline content and a greater stomatal aperture than the non-transgenic control plants.

A second experiment imposing drought stress on the transgenic plants was by treatment with a solution of PEG as described in the previous examples. Tolerance of salinity and cold were measured using methods as described in example 3. It is found that ryegrass over-expressing stress related genes from *Brassica napus, Glycine max, Zea mays* or *Oryza sativa* are more resistant to salinity and cold stress that non-transgenic control plants. Plants that have tolerance to salinity or cold also have higher seed yields, photosynthesis and dry matter production than susceptible plants.

EXAMPLE 17

Engineering Stress-Tolerant Soybean Plants by Over-Expressing Stress Related Genes from *Brassica napus, Glycine max, Zea mays* or *Oryza saliva*

Soybean is transformed according to the following modification of the method described in the Texas A&M U.S. Pat. No. 5,164,310. Several commercial soybean varieties are amenable to transformation by this method. The cultivar Jack (available from the Illinois Seed Foundation) is a commonly used for transformation. Seeds are sterilized by immersion in 70% (v/v) ethanol for 6 min and in 25% commercial bleach (NaOCl) supplemented with 0.1% (v/v) Tween for 20 min, followed by rinsing 4 times with sterile double distilled water. Seven-day old seedlings are propagated by removing the radicle, hypocotyl and one cotyledon from each seedling. Then, the epicotyl with one cotyledon is transferred to fresh germination media in petri dishes and incubated at 25° C. under a 16-hr photoperiod (approx. 100 μE-m-2s-1) for three weeks. Axillary nodes (approx. 4 mm in length) are cut from 3-4 week-old plants. Axillary nodes are excised and incubated in *Agrobacterium* LBA4404 culture.

Many different binary vector systems have been described for plant transformation (e.g. An, G. in *Agrobacterium* Protocols. Methods in Molecular Biology vol 44, pp 47-62, Gartland K M A and M R Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,767,366 and 6,225,105). Similarly, various promoters can be used to regulate the trait gene to provide constitutive, developmental, tissue or environmental regulation of gene transcription. In this example, the 34S promoter (GenBank Accession numbers M59930 and X16673) is used to provide constitutive expression of the trait gene.

After the co-cultivation treatment, the explants are washed and transferred to selection media supplemented with 500 mg/L timentin. Shoots are excised and placed on a shoot elongation medium. Shoots longer than 1 cm are placed on rooting medium for two to four weeks prior to transplanting to soil.

The primary transgenic plants (T0) are analyzed by PCR to confirm the presence of T-DNA. These results are confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

Stress-tolerant soybean plants over-expressing stress related genes from *Brassica napus, Glycine max, Zea mays* or *Oryza sativa* have higher seed yields, maintain their stomatal aperture and show only slight changes in osmotic potential and proline levels, whereas the susceptible non-transgenic control plants close their stomata and exhibit increased osmotic potential and proline levels.

Tolerance of drought, salinity and cold are measured using methods as described in example 3. Plants that have displayed tolerance to salinity or cold have higher seed yields, photosynthesis and dry matter production than susceptible plants.

EXAMPLE 18

Engineering Stress-Tolerant Rapeseed/Canola Plants by Over-Expressing Stress Related Genes from *Brassica napus, Glycine max, Zea mays* or *Oryza sativa*

Cotyledonary petioles and hypocotyls of 5-6 day-old young seedlings are used as explants for tissue culture and transformed according to Babic et al. (1998, Plant Cell Rep 17: 183-188). The commercial cuttivar Westar (Agriculture Canada) is the standard variety used for transformation, but other varieties can be used.

*Agrobacterium tumefaciens* LBA4404 containing a binary vector is used for canola transformation. Many different binary vector systems have been described for plant transformation (e.g. An, G. in *Agrobacterium* Protocols. Methods in Molecular Biology vol 44, pp 47-62, Gartland K M A and M R Davey eds. Humana Press, Totowa, N.J.). Many are based on the vector pBIN19 described by Bevan (Nucleic Acid Research. 1984. 12:8711-8721) that includes a plant gene expression cassette flanked by the left and right border sequences from the Ti plasmid of *Agrobacterium tumefaciens*. A plant gene expression cassette consists of at least two genes—a selection marker gene and a plant promoter regulating the transcription of the cDNA or genomic DNA of the trait gene. Various selection marker genes can be used including the *Arabidopsis* gene encoding a mutated acetohydroxy acid synthase (AHAS) enzyme (U.S. Pat. Nos. 5,767,3666 and 6,225,105). Similarly, various promoters can be used to regulate the trait gene to provide constitutive, developmental, tissue or environmental regulation of gene transcription. In this example, the 34S promoter (GenBank Accession numbers M59930 and X16673) is used to provide constitutive expression of the trait gene.

Canola seeds are surface-sterilized in 70% ethanol for 2 min., and then in 30% Clorox with a drop of Tween-20 for 10 min, followed by three rinses with sterilized distilled water. Seeds are then germinated in vitro 5 days on half strength MS medium without hormones, 1% sucrose, 0.7% Phytagar at 23° C., 16 hr. light. The cotyledon petiole explants with the cotyledon attached are excised from the in vitro seedlings, and inoculated with *Agrobacterium* by dipping the cut end of the petiole explant into the bacterial suspension. The explants are then cultured for 2 days on MSBAP-3 medium containing 3 mg/l BAP, 3% sucrose, 0.7% Phytagar at 23° C., 16 hr light After two days of co-cultivation with *Agrobacterium*, the petiole explants are transferred to MSBAP-3 medium containing 3 mg/l BAP, cefotaxime, carbenicillin, or timentin (300 mg/l) for 7 days, and then cultured on MSBAP-3 medium with cefotaxime, carbenicillin, or timentin and selection agent until shoot regeneration. When the shoots are 5-10 mm in length, they are cut and transferred to shoot elongation medium (MSBAP-0.5, containing 0.5 mg/l BAP). Shoots of about 2 cm in length are transferred to the rooting medium (MS0) for root induction.

Samples of the primary transgenic plants (T0) are analyzed by PCR to confirm the presence of T-DNA. These results are confirmed by Southern hybridization in which DNA is electrophoresed on a 1% agarose gel and transferred to a positively charged nylon membrane (Roche Diagnostics). The PCR DIG Probe Synthesis Kit (Roche Diagnostics) is used to prepare a digoxigenin-labelled probe by PCR, and used as recommended by the manufacturer.

The transgenic plants are then evaluated for their improved stress tolerance according to the method described in Example 3. It is found that transgenic Rapeseed/Canola over-expressing stress related genes from *Brassica napus, Glycine max, Zea mays* or *Oryza sativa* are more tolerant to environmental stress than non-transgenic control plants. Tolerant plants have higher seed yields, maintain their stomatal aperture and show only slight changes in osmotic potential and proline levels, whereas the susceptible non-transgenic control plants close their stomata and exhibited increased osmotic potential and proline levels are Plants that have tolerance to salinity or cold have higher seed yields, photosynthesis and dry matter production than susceptible plants.

EXAMPLE 19

Engineering Stress-Tolerant Corn Plants by Over-Expressing Stress Related Genes from *Brassica napus, Glycine max, Zea mays* or *Oryza saliva*

Transformation of corn (*Zea mays* L.) is performed with a modification of the method described by Ishida et al. (1996. Nature Biotech 14745-50). Transformation is genotype-dependent in corn and only specific genotypes are amenable to transformation and regeneration. The inbred line A188 (University of Minnesota) or hybrids with A188 as a parent are good sources of donor material for transformation (Fromm et al. 1990 Biotech 8:833-839), but other genotypes can be used successfully as well. Ears are harvested from corn plants at approximately 11 days after pollination (DAP) when the length of immature embryos is about 1 to 1.2 mm. Immature embryos are co-cultivated with *Agrobacterium tumefaciens* that carry "super binary" vectors and transgenic plants are recovered through organogenesis. The super binary vector system of Japan Tobacco is described in WO patents WO94/00977 and WO95/06722. Vectors are constructed as described. Various selection marker genes can be used including the corn gene encoding a mutated acetohydroxy acid synthase (AHAS) enzyme (U.S. Pat. No. 6,025,541). Similarly, various promoters can be used to regulate the trait gene to provide constitutive, developmental, tissue or environmental regulation of gene transcription. In this example, the 34S promoter (GenBank Accession numbers M59930 and X16673) is used to provide constitutive expression of the trait gene.

Excised embryos are grown on callus induction medium, then corn regeneration medium, containing imidazolinone as a selection agent The Petri plates were incubated in the light at 25° C. for 2-3 weeks, or until shoots develop. The green shoots from each embryo are transferred to corn rooting medium and incubated at 25° C. for 2-3 weeks, until roots develop. The rooted shoots are transplanted to soil in the greenhouse. T1 seeds are produced from plants that exhibit tolerance to the imidazolinone herbicides and are PCR positive for the transgenes.

The T1 transgenic plants are then evaluated for their improved stress tolerance according to the methods described in Example 3. The T1 generation of single locus insertions of the T-DNA will segregate for the transgene in a 1:2:1 ratio. Those progeny containing one or two copies of the transgene (¾ of the progeny) are tolerant of the imidazolinone herbicide, and exhibit greater tolerance of drought stress than those progeny lacking the transgenes. Tolerant plants have higher seed yields, maintained their stomatal aperture and showed only slight changes in osmotic potential and proline levels, whereas the susceptible non-transgenic control plants closed their stomata and exhibited increased osmotic potential and proline levels. Homozygous T2 plants exhibited similar phenotypes. Hybrid plants (F1 progeny) of homozygous transgenic plants and non-transgenic plants also exhibited increased environmental stress tolerance.

Tolerance to salinity and cold are measured using methods as described in the previous example 3. Again, transgenic corn plants over-expressing stress related genes from *Brassica napus, Glycine max, Zea mays* or *Oryza sativa* are found to be tolerant to environmental stresses. Plants that have tolerance to drought, salinity or cold have higher seed yields, photosynthesis and dry matter production than susceptible plants.

EXAMPLE 20

Engineering Stress-Tolerant Wheat Plants by Over-Expressing Stress Related Genes from *Brassica napus, Glycine max, Zea mays* or *Oryza sativa*

Transformation of wheat is performed with the method described by Ishida et al. (1996 Nature Biotech. 14745-50). The cultivar Bobwhite (available from CYMMIT, Mexico) is commonly used in transformation. Immature embryos are co-cultivated with *Agrobacterium tumefaciens* that carry "super binary" vectors, and transgenic plants are recovered through organogenesis. The super binary vector system of Japan Tobacco is described in WO patents WO94/00977 and WO95/06722. Vectors are constructed as described. Various selection marker genes can be used including the maize gene encoding a mutated acetohydroxy acid synthase (AHAS) enzyme (U.S. Pat. No. 6,025,541). Similarly, various promoters can be used to regulate the trait gene to provide constitutive, developmental, tissue or environmental regulation of gene transcription. In this example, the 34S promoter (GenBank Accession numbers M59930 and X16673) is used to provide constitutive expression of the trait gene.

After incubation with *Agrobacterium*, the embryos are grown on callus induction medium, then regeneration medium, containing imidazolinone as a selection agent. The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the imidazolinone herbicides and which are PCR positive for the transgenes.

The T1 transgenic plants are then evaluated for their improved stress tolerance according to the method described in the previous example 3. The T1 generation of single locus insertions of the T-DNA will segregate for the transgene in a 1:2:1 ratio. Those progeny containing one or two copies of the transgene (¾ of the progeny) are tolerant of the imidazolinone herbicide, and exhibit greater tolerance of drought stress than those progeny lacking the transgenes. Tolerant plants have higher seed yields, maintained their stomatal aperture and showed only slight changes in osmotic potential and proline levels, whereas the susceptible non-transgenic control plants closed their stomata and exhibited increased osmotic potential and proline levels. Homozygous T2 plants exhibited similar phenotypes. Tolerance of salinity and cold are measured using methods as described in the previous examples. Plants that overexpressed stress related genes from *Brassica napus, Glycine max, Zea mays* or *Oryza sativa* have tolerance to drought, salinity or cold and displayed have higher seed yields, photosynthesis and dry matter production than non-transgenic, susceptible plants.

EXAMPLE 21

Identification of Identical and Heterologous Genes

Gene sequences can be used to identify identical or heterologous genes from cDNA or genomic libraries. Identical genes (e.g. full-length cDNA clones) can be isolated via nucleic acid hybridization using for example cDNA libraries. Depending on the abundance of the gene of interest, 100,000 up to 1,000,000 recombinant bacteriophages are plated and transferred to nylon membranes. After denaturation with alkali, DNA is immobilized on the membrane by e.g. UV cross linking. Hybridization is carried out at high stringency conditions. In aqueous solution, hybridization and washing is performed at an ionic strength of 1 M NaCl and a temperature of 68° C.

Hybridization probes are generated by e.g. radioactive ($^{32}P$) nick transcription labeling (High Prime, Roche, Mannheim, Germany). Signals are detected by autoradiography.

Partially identical or heterologous genes that are similar but not identical can be identified in a manner analogous to the above-described procedure using low stringency hybridization and washing conditions. For aqueous hybridization, the ionic strength is normally kept at 1 M NaCl while the temperature is progressively bared from 68 to 42° C.

Isolation of gene sequences with homology (or sequence identity/similarity) in only a distinct domain of for example 10-20 amino acids can be carried out using synthetic radio labeled oligonucleotide probes. Radiolabeled oligonucleotides are prepared by phosphorylation of the 5-prime end of two complementary oligonucleotides with T4 polynucleotide kinase. The complementary oligonucleotides are annealed and ligated to form concatemers. The double stranded concatemers are then radiolabeled by, for example, nick transcription. Hybridization is normally performed at low stringency conditions using high oligonucleotide concentrations.

Oligonucleotide Hybridization Solution:

6×SSC 0.01 M sodium phosphate 1 mM EDTA (pH 8)

0.5% SDS

100 µg/ml denatured salmon sperm DNA 0.1% nonfat dried milk

During hybridization, temperature is lowered stepwise to 5-10° C. below the estimated oligonucleotide $T_m$ or down to room temperature followed by washing steps and autoradiography. Washing is performed with low stringency such as 3 washing steps using 4×SSC. Further details are described by Sambrook, J. et al., 1989. "Molecular Cloning: A Laboratory Manual," Cold Spring Harbor Laboratory Press or Ausubel, F. M. et al., 1994, "Current Protocols in Molecular Biology," John Wiley & Sons.

EXAMPLE 22

Identification of Identical or Homologous Genes by Screening Expression Libraries with Antibodies c-DNA clones can be used to produce recombinant polypeptide for example in *E. coli* (e.g. Qiagen QIAexpress pQE system). Recombinant polypeptides are then normally affinity purified via Ni-NTA affinity chromatography (Qiagen). Recombinant polypeptides are then used to produce specific antibodies for example by using standard techniques for rabbit immunization. Antibodies are affinity purified using a Ni-NTA column saturated with the recombinant antigen as described by Gu et al., 1994, BioTechniques 17:257-262. The antibody can then be used to screen expression cDNA libraries to identify identical or heterologous genes via an immunological screening (Sambrook, J. et al., 1989, "Molecular Cloning: A Laboratory Manual," Cold Spring Harbor Laboratory Press or Ausubel, F. M. et al., 1994, "Current Protocols in Molecular Biology", John Wiley & Sons).

EXAMPLE 23

In vivo Mutagenesis

In vivo mutagenesis of microorganisms can be performed by passage of plasmid (or other vector) DNA through *E. coli* or other microorganisms (e.g. *Bacillus* spp. or yeasts such as *Saccharomyces cerevisiae*), which are impaired in their capabilities to maintain the integrity of their genetic information. Typical mutator strains have mutations in the genes for the DNA repair system (e.g., mutHLS, mutD, mutT, etc.; for reference, see Rupp, W. D., 1996, DNA repair mechanisms, in: *Escherichia coli* and *Salmonella*, p. 2277-2294, ASM: Washington.) Such strains are well known to those skilled in the art. The use of such strains is illustrated, for example, in Greener, A. and Callahan, M., 1994, Strategies 7: 32-34. Transfer of mutated DNA molecules into plants is preferably done after selection and testing in microorganisms. Transgenic plants are generated according to various examples within the exemplification of this document.

SEQUENCE LISTING (977 sequences)

SEQ ID NO: 1 - DNA, 1170 bp, Saccharomyces cerevisiae
  CDS (1)..(1170)
atggtgaaacatctgcatcgattctttagcagtgatgcctcgggaggcattattcttatcattgccgctatcctggcgatgattatggccaacagcggcgcaaccagtggatggtatcacgactttctggagacgccggttcagctccgggttggttcactcgaaatcaacaaaaacatgctgttatggataaatgacgcgctgatggcggtatttttcctgttagtcggtctggaagttaaacgtgaactgatgcaaggatcgctagccagcttacgccaggccgcatttccagttatcgccgctattggtgggatgattgtgccggcattactctatctggcttttaactatgccgatccgattacccgcgaagggtgggcgatcccggcggctactgacattgcttttgcacttggtgtactggcgctgttgggaagtcgtgttccgttagcgctgaagatctttttgatggctctggctattatcgacgatcttggggccatcattatcatcgcattgttctacactaatgacttatcgatggcctctcttggcgtcgcggctgtagcaattgcggtactcgcggtattgaatctgtgtggtgcacgccgcacgggcgtctatattcttgttggcgtggtgttgtggactgcggtgttgaaatcgggggttcacgcaactctggcgggggtaattgtcggcttctttattcctttgaaagagaagcatgggcgttctccagcgaagcgactggagcatgtgttgcacccgtgggtggcgtatctgattttgccgctgtttgcatttgctaatgctggcgtttcactgcaaggcgtcacgctggatggcttgacctccattctgccattggggatcatcgctggcttgctgattggcaaaccgctggggattagtctgttctgctggttggcgctgcgtttgaaactggcgcatctgcctgagggaacgacttatcagcaaattatggtggtggggatcctgtgcggtatcggttttactatgtctatctttattgccagcctggcctttggtagcgtagatccagaactgattaactgggcgaaactcggtatcctggtcggttctatctcttcggcggtaattggatacagctggttacgcgttcgtttgcgtccatcagtttga

SEQ ID NO: 2 - protein, 389 aa, Saccharomyces cerevisiae
MVKHLHRFFSSDASGGIILIIAAILAMIMANSGATSGWYHDFLETPVQLRVGSLEINKNMLLWINDALMAVFFLLVGLEVKRELMQGSLASLRQAAFPVIAAIGGMIVPALLYLAFNYADPITREGWAIPAATDIAFALGVLALLGSRVPLALKIFLMALAIIDDLGAIIIIALFYTNDLSMASLGVAAVAIAVLAVLNLCGARRTGVYILVGVVLWTAVLKSGVHATLAGVIVGFFIPLKEKHGRSPAKRLEHVLHPWVAYLILPLFAFANAGVSLQGVTLDGLTSILPLGIIAGLLIGKPLGISLFCWLALRLKLAHLPEGTTYQQIMVVGILCGIGFTMSIFIASLAFGSVDPELINWAKLGILVGSISSAVIGYSWLRVRLRPSV

SEQ ID NO: 3 - DNA, 36 bp, Artificial sequence
  primer
ttgctcttccatgaaacatctgcatcgattctttag

SEQ ID NO: 4 - DNA, 35 bp, Artificial sequence
  primer
ttgctcttcgttaaactgatggacgcaaacgaacg

SEQ ID NO: 5 - DNA, 723 bp, Saccharomyces cerevisiae
  CDS (1)..(723)
atgggacacaagcccttataccggcagattgccgatcgcattcgtgaacaaattgcgcgtggcgagcttaaacctggcgatgcgttacccactgaatcagcgctacaaacagagtttggcgtcagccgggttacggtgcgtcaggctttgcgccagctagtcgagcagcagatcctcgaaagcattcagggcagcgggacttacgtcaaagaagagcgggtcaattacgatatttttcagttaaccagttttgatgaaaaactgtcggaccgtcacgtcgatacacacagtgaagttctgatattcgaagtgattccggctgacgattttcttcagcaacagctacaaatcaccccgcaggatcgtgtgtggcatgtgaagcgcgtgcgctatcgcaagcaaaagccaatggcgctggaagaaacctggatgccgcttgcgttgttcccggatctcacctggcaggtcatggaaaattcgaaatatcactttatcgaagaagtgaagaaaatggttatcgatcgtagcgaacaggaaatcattcctctgatgccaaccgaagagatgagccgtctgcttaatatcagccagacaaagccgattcttgaaaaagtatcgcgtggatatttagttgatggtcgggtgtttgaatatagccgcaacgcttttaataccgatgactataaatttaccctgatagcgcagcgaaaatcatcgcgataa

SEQ ID NO: 6 - protein, 240 aa, Saccharomyces cerevisiae
MGHKPLYRQIADRIREQIARGELKPGDALPTESALQTEFGVSRVTVRQALRQLVEQQILESIQGSGTYVKEERVNYDIFQLTSFDEKLSDRHVDTHSEVLIFEVIPADDFLQQQLQITPQDRVWHVKRVRYRKQKPMALEETWMPLALFPDLTWQVMENSKYHFIEEVKKMVIDRSEQEIIPLMPTEEMSRLLNISQTKPILEKVSRGYLVDGRVFEYSRNAFNTDDYKFTLIAQRKSSR

SEQ ID NO: 7 - DNA, 33 bp, Artificial sequence
  primer
ttgctcttccatgggacacaagcccttataccg

SEQ ID NO: 8 - DNA, 33 bp, Artificial sequence
  primer
ttgctcttcgttatcgcgatgattttcgctgcg

SEQ ID NO: 9 - DNA, 1191 bp, Saccharomyces cerevisiae
  CDS (1)..(1191)
atgacaacaaacactgtttcccgcaaagtggcgtggctacgggtcgttacgctggcagtcgccgccttcatcttcaacaccaccgaatttgtccctgttggcctgctctctgacattgcgcaaagttttcacatgcaaaccgctcaggtcggcatcatgttgaccatttacgcatgggtagtagcgctaatgtcattgccttttatgttaatgaccagtcaggttgaacggcgcaaattactgatctgcctgtttgtggtgtttattgccagccacgtactgtcgtttttgtcgtggagctttaccgttctggtgatcagtcgcattggtgtggcttttgcacatgcgattttctggtcgattacggcgtctctggcgatccgtatggctccggccgggaagcgagcacaggcattgagtttaattgccaccggtacagcactggcgatggtcttaggtttacctctcgggcgcattgtgggccagtatttcggttggcgaatgaccttcttcgcgattggtattggggcgcttatcacccttttgtgcctgattaagttacttcccttactgcccagtgagcattccggttcactgaaaagcctcccgctattgttccgccgcccggcattgatgagcatttatttgttaactgtggtggttgtcaccgcccattacacggcatacagctatatcgagccttttgtacaaaacattgcgggattcagcgccaactttgccacggcattactgttattactcggtggtgcgggcattattggcagcgtgattttcggtaaactgggtaatcagtatgcgtctgcgttggtgagtacggcgattgcgctgttgctggtgtgcctggcattgctgttacctgcggcgaacagtgaaatacacctcggggtgctgagtattttctgggggatcgcgatgatgatcatcgggcttggtatgcaggttaaagtgctggcgctggcaccagatgctaccgacgtcgcgatggcgctattctccggcatatttaatattggaatcggggcgggtgcgttggtaggtaatcaggtgagtttgcactggtcaatgtcgatgattggttatgtgggcgcggtgcctgcttttgccgcgttaatttggtcaatcattatatttcgccgctggccagtgacactcgaagaacagacgcaatag

SEQ ID NO: 10 - protein, 396 aa, Saccharomyces cerevisiae
MTTNTVSRKVAWLRVVTLAVAAFIFNTTEFVPVGLLSDIAQSFHMQTAQVGIMLTIYAWVVALMSLPFMLMTSQVERRKLLICLFVVFIASHVLSFLSWSFTVLVISRIGVAFAHAIFWSITASLAIRMAPAGKRAQALSLIATGTALAMVLGLPLGRIVGQYFGWRMTFFAIGIGALITLLCLIKLLPLLPSEHSGSLKSLPLLFRRPALMSIYLLTVVVVTAHYTAYSYIEPFVQNIAGFSANFATALLLLLGGAGIIGSVIFGKLGNQYASALVSTAIALLLVCLALLLPAANSEIHLGVLSIFWGIAMMIIGLGMQVKVLALAPDATDVAMALFSGIFNIGIGAGALVGNQVSLHWSMSMIGYVGAVPAFAALIWSIIIFRRWPVTLEEQTQ

SEQ ID NO: 11 - DNA, 34 bp, Artificial sequence
  primer
ttgctcttccatgacaacaaacactgtttcccgc

SEQ ID NO: 12 - DNA, 35 bp, Artificial sequence
  primer
ttgctcttcgttattgcgtctgttcttcgagtgtc

SEQ ID NO: 13 - DNA, 2049 bp, Saccharomyces cerevisiae
  CDS (1)..(2049)
atgaacatgttttttaggcttaccgcgttagctggcctgcttgcaatagcaggccagaccttcgctgtagaagatatcacgcgtgctgatcaaattccggtattaaaggaagagacgcagcatgcgacggtaagtgagcgcgtaacgtcgcgcttcacccgttctcattatcgccagttcgacctcgatcaggcattttcggccaaaatctttgaccgctacctgaatctgctcgattacagccacaacgtgctgctggcaagcgatgttgaacagttcgcgaaaaagaaaaccgagttaggcgatgaactgcgttcaggcaaactcgacgttttctacgatctctacaatctggcgcaaaagcgccgttttgagcgttaccagtacgctttgtcggtactggaaaagccgatggatttcaccggcaacgacacttataaccttgaccgcagcaaagcgccctggccgaaaaacgaggctgagttgaacgcgctgtgggacagtaaagtcaaattcgacgagttaagcctgaagctgacaggaaaaacggataaagaaattcgtgaaaccctgactcgccgctacaaatttgccattcgtcgtctggcgcaaaccaacagcgaagatgttttctcgctggcaatgacggcgtttgcgcgtgaaatcgacccgcataccaactatctttccccgcgtaataccgaacagttcaacactgaaatgagtttgtcgctggaaggtattggcgcagtgctgcaaatggatgatgactacaccgttatcaattcgatggtggcaggtggtccggcagcgaagagtaaagctatcagcgttggtgacaaaattgtcggtgttggtcaaacaggcaagccgatggttgacgtgattggctggcgtcttgatgatgtggttgccttaattaaagggccgaagggcagtaaagttcgtctggaaattttacctgctggtaaagggaccaagacccgtactgtaacgttgacccgtgaacgtattcgtctcgaagaccgcgcggttaaaatgtcggtgaagaccgtcggtaaagagaaagtcggcgtgctggatattccgggcttctatgtgggtttgacagacgatgtcaaagtgcaactgcagaaactggaaaaacagaatgtcagcagcgtcatcatcgacctgcgtagcaatggcggtggggcgttaactgaagccgtatcgctctccggtctgtttattcctgcgggtcccattgttcaggtccgcgataacaacggcaaggttcgtgaagatagcgataccgacggacaggttttctataaaggcccgctggtggtgctggttgaccgcttcagtgcttcggcttcagaaatctttgccgcggcaatgcaggattacggtcgtgcgctggttgtgggtgaaccgacgtttggtaaaggcaccgttcagcaataccgttcattgaaccgtatttacgatcagatgttacgtcctgaatggccagcgctgggttctgtgcagtacacgatccagaaattctatcgcgttaacggcggcagtacgcaacgtaaaggcgtaacgccagacatcatcatgccgacgggtaatgaagaaacggaaacgggtgagaaattcgaagataacgcgctgccgtgggatagcattgatgccgcgacttatgtgaaatcaggagatttaacggcctttgaaccggagctgctgaaggaacataatgcgcgtatcgcgaaagatcctgagttccagaacatcatgaaggatatcgcgcgcttcaacgctatgaaggacaagcgcaatatcgtttctctgaattacgctgtgcgtgagaaagagaataatgaagatgatgcgacgcgtctggcgcgtttgaacgaacgctttaaacgcgaaggtaaaccggagttgaagaaactggatgatctaccgaaagattaccaggagccggatccttatctggatgagacggtgaatatcgcactcgatctggcgaagcttgaaaaagccagacccgcggaacaacccgctcccgtcaagtaa

SEQ ID NO: 14 - protein, 682 aa, Saccharomyces cerevisiae
MNMFFRLTALAGLLAIAGQTFAVEDITRADQIPVLKEETQHATVSERVTSRFTRSHYRQFDLDQAFSAKIFDRYLNLLDYSHNVLLASDVEQFAKKKTELGDELRSGKLDVFYDLYNLAQKRRFERYQYALSVLEKPMDFTGNDTYNLDRSKAPWPKNEAELNALWDSKVKFDELSLKLTGKTDKEIRETLTRRYKFAIRRLAQTNSEDVFSLAMTAFAREIDPHTNYLSPRNTEQFNTEMSLSLEGIGAVLQMDDDYTVINSMVAGGPAAKSKAISVGDKIVGVGQTGKPMVDVIGWRLDDVVALIKGPKGSKVRLEILPAGKGTKTRTVTLTRERIRLEDRAVKMSVKTVGKEKVGVLDIPGFYVGLTDDVKVQLQKLEKQNVSSVIIDLRSNGGGALTEAVSLSGLFIPAGPIVQVRDNNGKVREDSDTDGQVFYKGPLVVLVDRFSASASEIFAAAMQDYGRALVVGEPTFGKGTVQQYRSLNRIYDQMLRPEWPALGSVQYTIQKFYRVNGGSTQRKGVTPDIIMPTGNEETETGEKFEDNALPWDSIDAATYVKSGDLTAFEPELLKEHNARIAKDPEFQNIMKDIARFNAMKDKRNIVSLNYAVREKENNEDDATRLARLNERFKREGKPELKKLDDLPKDYQEPDPYLDETVNIALDLAKLEKARPAEQPAPVK

SEQ ID NO: 15 - DNA, 32 bp, Artificial sequence
  primer
ttgctcttccatgatgcgaatcgcgctcttcc

SEQ ID NO: 16 - DNA, 34 bp, Artificial sequence
  primer
ttgctcttcgttacttcaggtattcacccgtacg

SEQ ID NO: 17 - DNA, 1182 bp, Saccharomyces cerevisiae
  CDS (1)..(1182)
atgcataactcccccgcagtctccagcgcgaaatcgtttgacctgacctcgacggcgtttttaatcgttgcctttctcaccggtattgcgggcgctctgcaaaccccgacactcagtatttttcttaccgatgaagtacatgcccgtccggcgatggtgggattcttctttaccggcagcgctgtcattgggattctggtaagtcagtttctcgccgggcgctctgataagcgcggcgatcgcaaatcgctgattgtcttttgctgcctgttaggcgtgctggcctgcaccctttttgcctggaatcgcaactactttgttttgctattcgttggcgtctttcttagcagctttggctcgaccgctaacccgcaaatgtttgcccttgcccgtgaacatgccgacaaaaccggacgtgaggcggtgatgttcagctcttttttacgcgctcaggtttcactggcatgggtcattggcccaccgctggcttatgccttagcgatgggtttcagctttacggtaatgtatctgagcgcagcggtagcgtttattgtttgcggtgtgatggtgtggctgtttttaccgtcgatgcgaaaagagcttccgctggcgaccggcacgatcgaagcgccgcgccgtaaccgtcgcgatacgctgctgctgtttgtcatttgtacattgatgtggggctcgaacagcctgtacatcatcaacatgccgctatttattatcaacgaactgcatcttcccgagaaactggccggtgtgatgatggggaccgccgccgggctggaaatcccgacgatgttgattgccggatatttcgccaaacgtctgggtaagcgtttcttaatgcgcgttgctgccgtgggtggcgtctgtttttacgcaggaatgctgatggcgcattcacctgtcattctgttgggcttgcagctgctaaatgctatttttattggcattctgggcggcatcgggatgctctattttcaggatctgatgcccggtcaggcgggttcagccaccacgctctataccaacacttcgcgcgtgggctggatcatcgcaggatcagtggcgggcatcgtcgccgagatctggaattatcacgctgtgttctggtttgcgatggtgatgattatcgccactctgttttgcttactgcggattaaagatgtttaa

SEQ ID NO: 18 - protein, 393 aa, Saccharomyces cerevisiae
MHNSPAVSSAKSFDLTSTAFLIVAFLTGIAGALQTPTLSIFLTDEVHARPAMVGFFFTGSAVIGILVSQFLAGRSDKRGDRKSLIVFCCLLGVLACTLFAWNRNYFVLLFVGVFLSSFGSTANPQMFALAREHADKTGREAVMFSSFLRAQVSLAWVIGPPLAYALAMGFSFTVMYLSAAVAFIVCGVMVWLFLPSMRKELPLATGTIEAPRRNRRDTLLLFVICTLMWGSNSLYIINMPLFIINELHLPEKLAGVMMGTAAGLEIPTMLIAGYFAKRLGKRFLMRVAAVGGVCFYAGMLMAHSPVILLGLQLLNAIFIGILGGIGMLYFQDLMPGQAGSATTLYTNTSRVGWIIAGSVAGIVAEIWNYHAVFWFAMVMIIATLFCLLRIKDV

SEQ ID NO: 19 - DNA, 31 bp, Artificial sequence
  primer
ttgctcttccatgcataactcccccgcagtc

SEQ ID NO: 20 - DNA, 36 bp, Artificial sequence
  primer
ttgctcttcgttaaacatctttaatccgcagtaagc

SEQ ID NO: 21 - DNA, 2136 bp, Saccharomyces cerevisiae
  CDS (1)..(2136)
atgcttaatccgatcgttcgtaaattccagtacggccaacacaccgtgactctggaaaccggcatgatggctcgtcaggctactgccgctgttatggttagcatggatgacaccgcggtattcgttaccgttgttggccagaaaaaagccaaaccaggtcaggacttcttcccactgaccgttaactatcaggagcgtacctacgctgctggtcgtatcccgggtagcttcttccgtcgtgaaggccgcccaagcgaaggcgaaaccctgatcgcgcgtctgattgaccgcccgattcgcccgctgttcccggaaggcttcgtcaacgaagttcaggttatcgccaccgtggtttctgttaacccgcaagttaacccggatatcgtcgcgatgattggtgcttccgcagcgctgtctctgtctggtattccgttcaatggcccgattggtgctgcccgcgtaggttacatcaatgaccagtacgtactgaacccgactcaggacgagctgaaagagagcaaactggatctggttgttgccggtactgaagccgctgtactgatggttgaatctgaagctcaactgctgagcgaagaccagatgctgggcgcagtagtgttcggtcatgaacaacagcaggttgttattcagaacatcaatgaactggtgaaagaagccggtaaaccgcgttgggactggcagccggagccggtaaacgaagcgctaaacgcgcgcgttgctgcactggctgaagctcgcctgagcgatgcttaccgcatcaccgacaaacaagagcgttatgcgcaggttgatgtcatcaaatctgaaaccatcgcgacgctgcttgctgaagacgaaaccctggacgaaaacgaactgggtgaaattctgcacgcgatcgagaaaaacgttgttcgtagccgcgtactggcaggcgaaccgcgtatcgacggtcgtgaaaaagatatgatccgtggtctggatgtgcgtactggcgtgctgccgcgtactcacggttctgcgctgttcacccgtggtgaaacgcaggcgctggttaccgcaacgctgggtactgctcgtgacgcgcaggttcttgatgaactgatgggcgaacgtaccgataccttcctgttccactacaacttccctccgtactccgtaggcgaaaccggcatggtcggttctccgaagcgtcgtgaaattggtcacggtcgtctggcgaagcgcggcgtgctggcagtcatgccggatatggacaaattcccgtacaccgtacgtgttgtgtctgaaatcactgaatccaacggttcctcttctatggcttccgtgtgcggcgcgtctctggcgctgatggacgcaggtgtgccgatcaaagctgccgttgcgggtatcgcaatgggtctggtgaaagaaggcgacaactacgttgtactgtctgacattttgggcgacgaagatcacctgggcgatatggacttcaaagttgcaggttcccgcgacggtatctctgcactgcagatggatatcaaaattgaaggtatcaccaaagagatcatgcaggttgcgctgaaccaggctaaaggtgcgcgtctgcatatcctgggcgtaatggaacaggcgatcaacgcgccgcgtggcgatatctctgagttcgcaccgcgtatccataccatcaagatcaacccggacaagatcaaagatgttatcggtaaaggcggttctgtaatccgtgctctgaccgaagaaactggcaccaccatcgaaatcgaagatgacggtactgtgaagattgcagcgaccgacggcgagaaagcgaaacatgctattcgtcgtatcgaagagatcactgcagaaatcgaagtgggccgcgtctacactggtaaagtgacccgtatcgttgactttggcgcatttgttgccatcggcggcggtaaagaaggtctggtccacatctctcaaatcgctgacaaacgcgttgagaaagtgaccgattacctgcagatgggtcaggaagtaccggtgaaagttctggaagttgatcgccagggccgtatccgtctgagcattaaagaagcgactgagcagtctcaacctgctgcagcaccggaagctccggctgctgaacagggcgagtaa

SEQ ID NO: 22 - protein, 711 aa, Saccharomyces cerevisiae
MLNPIVRKFQYGQHTVTLETGMMARQATAAVMVSMDDTAVFVTVVGQKKAKPGQDFFPLTVNYQERTYAAGRIPGSFFRREGRPSEGETLIARLIDRPIRPLFPEGFVNEVQVIATVVSVNPQVNPDIVAMIGASAALSLSGIPFNGPIGAARVGYINDQYVLNPTQDELKESKLDLVVAGTEAAVLMVESEAQLLSEDQMLGAVVFGHEQQQVVIQNINELVKEAGKPRWDWQPEPVNEALNARVAALAEARLSDAYRITDKQERYAQVDVIKSETIATLLAEDETLDENELGEILHAIEKNVVRSRVLAGEPRIDGREKDMIRGLDVRTGVLPRTHGSALFTRGETQALVTATLGTARDAQVLDELMGERTDTFLFHYNFPPYSVGETGMVGSPKRREIGHGRLAKRGVLAVMPDMDKFPYTVRVVSEITESNGSSSMASVCGASLALMDAGVPIKAAVAGIAMGLVKEGDNYVVLSDILGDEDHLGDMDFKVAGSRDGISALQMDIKIEGITKEIMQVALNQAKGARLHILGVMEQAINAPRGDISEFAPRIHTIKINPDKIKDVIGKGGSVIRALTEETGTTIEIEDDGTVKIAATDGEKAKHAIRRIEEITAEIEVGRVYTGKVTRIVDFGAFVAIGGGKEGLVHISQIADKRVEKVTDYLQMGQEVPVKVLEVDRQGRIRLSIKEATEQSQPAAAPEAPAAEQGE

SEQ ID NO: 23 - DNA, 34 bp, Artificial sequence
  primer
ttgctcttccatgcgcagaagatcgggtattaac

SEQ ID NO: 24 - DNA, 32 bp, Artificial sequence
  primer
ttgctcttcgttactcgccctgttcagcagcc

SEQ ID NO: 25 - DNA, 396 bp, Saccharomyces cerevisiae
  CDS (1)..(396)
atgtcctctgccgccgaaaagaaaccagcttccaaagctccagctgaaaagaagccagctgccaagaaaacatcaacctccgtcgatggtaagaagagatctaaggttagaaaggagacctattcctcttatatttacaaagttttgaagcaaactcacccagacactggtatttcccagaagtctatgtctattttgaactctttcgttaacgatatctttgaaagaattgctactgaagcttctaaattggccgcttataacaagaaatccactatttctgctagagaaatccaaacagccgttagattgatcttacctggtgaattggctaaacatgccgtctccgaaggtactagggctgttaccaaatactcctcctctactcaagcctaa

SEQ ID NO: 26 - protein, 131 aa, Saccharomyces cerevisiae
MSSAAEKKPASKAPAEKKPAAKKTSTSVDGKKRSKVRKETYSSYIYKVLKQTHPDTGISQKSMSILNSFVNDIFERIATEASKLAAYNKKSTISAREIQTAVRLILPGELAKHAVSEGTRAVTKYSSSTQA

SEQ ID NO: 27 - DNA, 42 bp, Artificial sequence
  primer
ggaattccagctgaccaccatgtcctctgccgccgaaaagaa

SEQ ID NO: 28 - DNA, 44 bp, Artificial sequence
  primer
gatccccgggaattgccatgttaggcttgagtagaggaggagta

SEQ ID NO: 29 - DNA, 861 bp, Saccharomyces cerevisiae
  CDS (1)..(861)
atggaaacggatagtggtatacctggtcattcatttgtgttaaagtggacaaaaaacatcttttcgcgcacattgcgtgcatctaactgtgtacctagacatgttgggttcatcatggatgggaacaggagattcgctagaaagaaagagatggacgtaaaggagggccacgaggcaggatttgttagtatgagtagaatcttagaactgtgttatgaagcaggagtcgatacggctaccgtgtttgccttttcaattgaaaatttcaagaggagctcacgggaagttgaatcactgatgactttagcgcgcgaaaggatacgacaaatcacagaacgtggagagctggcctgtaagtatggggtacgcattaaaattatcggcgatctctctttgttggataagtctctattagaagatgttcgggttgctgtggaaactacaaagaacaacaaaagggccacgttaaatatctgctttccatatacaggcagggaagaaatcttgcatgccatgaaagaaacaattgttcaacataagaagggcgccgctatagacgaaagcacgttagaatcgcatctctacacggcgggggtaccccctttagatttattgattaggacaagtggcgtttccagattaagtgactttttgatatggcaggcatcgagtaagggcgtacgcatcgaattgctggattgtttatggccagagtttggacctatacggatggcatggattttattaaaattttcgtttcacaaatcctttttaaacaaagagtacagattagaggaaggtgattatgacgaggaaaccaatggggaccccatcgatttgaaagaaaaaaagttgaattaa

SEQ ID NO: 30 - protein, 286 aa, Saccharomyces cerevisiae
METDSGIPGHSFVLKWTKNIFSRTLRASNCVPRHVGFIMDGNRRFARKKEMDVKEGHEAGFVSMSRILELCYEAGVDTATVFAFSIENFKRSSREVESLMTLARERIRQITERGELACKYGVRIKIIGDLSLLDKSLLEDVRVAVETTKNNKRATLNICFPYTGREEILHAMKETIVQHKKGAAIDESTLESHLYTAGVPPLDLLIRTSGVSRLSDFLIWQASSKGVRIELLDCLWPEFGPIRMAWILLKFSFHKSFLNKEYRLEEGDYDEETNGDPIDLKEKKLN

SEQ ID NO: 31 - DNA, 43 bp, Artificial sequence
  primer
ggaattccagctgaccaccatggaaacggatagtggtatacct

SEQ ID NO: 32 - DNA, 48 bp, Artificial sequence
  primer
gatccccgggaattgccatgttaattcaactttttttctttcaaatcg

SEQ ID NO: 33 - DNA, 411 bp, Saccharomyces cerevisiae
  CDS (1)..(411)
atggccagaacaaagcaaacagcaagaaagtccactggtggtaaggccccaagaaagcaattagcttctaaggctgccagaaaatccgccccatctaccggtggtgttaagaagcctcacagatataagccaggtactgttgctttgagagaaatcagaagattccaaaaatctactgaactgttgatcagaaagttgcctttccaaagattggtcagagaaatcgctcaagatttcaagaccgacttgagatttcaatcttctgccatcggtgccttgcaagaatctgtcgaagcctacttagtctctttatttgaagataccaacttggctgccattcacgccaagcgtgtcactatccaaaagaaggatatcaagttggctagaagattaagaggtgaaagatcatag

SEQ ID NO: 34 - protein, 136 aa, Saccharomyces cerevisiae
MARTKQTARKSTGGKAPRKQLASKAARKSAPSTGGVKKPHRYKPGTVALREIRRFQKSTELLIRKLPFQRLVREIAQDFKTDLRFQSSAIGALQESVEAYLVSLFEDTNLAAIHAKRVTIQKKDIKLARRLRGERS

SEQ ID NO: 35 - DNA, 43 bp, Artificial sequence
  primer
ggaattccagctgaccaccatggccagaacaaagcaaacagca

SEQ ID NO: 36 - DNA, 46 bp, Artificial sequence
  primer
gatccccgggaattgccatgctatgatctttcacctcttaatcttc

SEQ ID NO: 37 - DNA, 369 bp, Saccharomyces cerevisiae
  CDS (1)..(369)
atggtacccgcacctgggtcacgtgcattcccctcacccgtttttttaggtggtgtcttttttgtttttttttttaggtggcgcggcaactataaagtacagcaagtgaggttgaggcaatactgggagtttacactatgggagacagctcctaacaccaagcagaaaaacgactttttcgcaaaaacattaacatatataaaactagcgctatggccgcaactaaagaagcaaagcaaccaaaggaaccaaagaagaggaccaccaggagaaagaaggatcctaacgcccctaagaggcggttgtcagcttatatgttctttgctaatgaaaacagagacattgtccgttccgagaatcctgacgtaa

SEQ ID NO: 38 - protein, 122 aa, Saccharomyces cerevisiae
MVPAPGSRAFPSPVFLGGVFFVFFFRWRGNYKVQQVRLRQYWEFTLWETAPNTKQKNDFFAKTLTYIKLALWPQLKKQSNQRNQRRGPPGERRILTPLRGGCQLICSLLMKTETLSVPRILT

SEQ ID NO: 39 - DNA, 40 bp, Artificial sequence
  primer
ggaattccagctgaccaccatggtacccgcacctgggtca

SEQ ID NO: 40 - DNA, 43 bp, Artificial sequence
  primer
gatccccgggaattgccatgttacgtcaggattctcggaacgg

SEQ ID NO: 41 - DNA, 444 bp, Saccharomyces cerevisiae
  CDS (1)..(444)
atgtcctccaatcttaccgaagaacaaattgctgaattcaaagaagcctttgccctctttgataaagataacaatggctctatctcatcaagtgaattggccactgtgatgaggtcattgggtctttcgcccagtgaagcagaagtaaatgatttgatgaacgaaatagatgttgatggtaaccatcaaatcgaatttagtgaatttttggctctgatgtctcgtcaactcaaatcaaatgactctgaacaagaactactagaagcttttaaagtattcgataagaacggtgatggtttaatctccgccgctgagttgaaacacgtgctaacatccattggtgaaaaattgactgatgccgaagtagatgatatgctaagagaggttagtgatggatcaggcgagatcaacattcaacaattcgctgctttgttatctaaatag

SEQ ID NO: 42 - protein, 147 aa, Saccharomyces cerevisiae
MSSNLTEEQIAEFKEAFALFDKDNNGSISSSELATVMRSLGLSPSEAEVNDLMNEIDVDGNHQIEFSEFLALMSRQLKSNDSEQELLEAFKVFDKNGDGLISAAELKHVLTSIGEKLTDAEVDDMLREVSDGSGEINIQQFAALLSK

SEQ ID NO: 43 - DNA, 43 bp, Artificial sequence
  primer
ggaattccagctgaccaccatgtcctccaatcttaccgaagaa

SEQ ID NO: 44 - DNA, 46 bp, Artificial sequence
  primer
gatccccgggaattgccatgctatttagataacaaagcagcgaatt

SEQ ID NO: 45 - DNA, 1452 bp, Saccharomyces cerevisiae
  CDS (1)..(1452)
atgtatttgtcattctatatcactgatacaaagaacaaacttattttccagtatcttttaggtgcaacagctccctccttcaagcacctgtggacccgcgttcgtaccacatgtcctcaattgctcgaagatagcagtagtgatgattatttagaccattcaatggttggaagagatttagaggtctataagtatttctcagttataaataagctcaattattggtgcttagcctccacttcgaagtcaaaaggcccgcttgattgttttacctttttagagactatagatcgtatcctgttagaatattttgacaaggataaattaagtatcaagaaaattgttaataattatgatagaatcagtttgatttttaactgttgcgtcgaagcgggtgaaccaaatgtgagtgatatgctctatgttaataaaattaaagaagctgttcctgaaagatcggatttatcgaagttcataagttctacagcccataatttacagcaggctgtgcaactcccacaacaaaggcaacagcagctacaacaaaatcagatttctcgtggtagtaattcactaatcgaaaatgaagagattgttccctggagaacttcaagggctagcaaacatgagaataatgagctttatgtggatttgttagaaacattccatgttgtatttgaaaagaaaaaatcacatctaaggttgctcactggaagtatccatggaatagtggacgtgagatcttatttgaatgataatcctctagttgcagtaaaattaaacactatgggaaatgatataggtatacccagtttgcatgactgtgttgaaatcaatgatggtgtgttttctccctctaatataacgtttataccaccagatgggaagttcagattgctggagtattccgtcgatttaagttctcaagtaaagcaatccggagtaaggatgaattctattggcttgatgtctttacacttccaaaatggattgggtaaagattctgatgaatttgagttatccttaaatattgaaaatttcaaaaaagtttcacaagttgatgacctaaaaatagatttacagttcaatgttgagaatgctgatccaaatgaaatagcatataagataaaaatattgcgcaatactcatggccgttttgaaaatagcattatcatgggtcaaggacaatggatttttgataaatcaactgccactggaacggtacctgtactacgtggctgtattgagtatgaaaatactgggccaaattttacaaaaaaagttgatttacaaacagtctccttagaatattcttacataggacaatcggccagtggaatctatgtagaagccatcgatattgtatctggattaacaattggcaaaaatacaaagctgtacaagggtgcaaagtataagacccagacaggcaattttcaagtaaggctgtag

SEQ ID NO: 46 - protein, 483 aa, Saccharomyces cerevisiae
MYLSFYITDTKNKLIFQYLLGATAPSFKHLWTRVRTTCPQLLEDSSSDDYLDHSMVGRDLEVYKYFSVINKLNYWCLASTSKSKGPLDCFTFLETIDRILLEYFDKDKLSIKKIVNNYDRISLIFNCCVEAGEPNVSDMLYVNKIKEAVPERSDLSKFISSTAHNLQQAVQLPQQRQQQLQQNQISRGSNSLIENEEIVPWRTSRASKHENNELYVDLLETFHVVFEKKKSHLRLLTGSIHGIVDVRSYLNDNPLVAVKLNTMGNDIGIPSLHDCVEINDGVFSPSNITFIPPDGKFRLLEYSVDLSSQVKQSGVRMNSIGLMSLHFQNGLGKDSDEFELSLNIENFKKVSQVDDLKIDLQFNVENADPNEIAYKIKILRNTHGRFENSIIMGQGQWIFDKSTATGTVPVLRGCIEYENTGPNFTKKVDLQTVSLEYSYIGQSASGIYVEAIDIVSGLTIGKNTKLYKGAKYKTQTGNFQVRL

SEQ ID NO: 47 - DNA, 46 bp, Artificial sequence
  primer
ggaattccagctgaccaccatgtatttgtcattctatatcactgat

SEQ ID NO: 48 - DNA, 45 bp, Artificial sequence
  primer
gatccccgggaattgccatgctacagccttacttgaaaattgcct

SEQ ID NO: 49 - DNA, 516 bp, Saccharomyces cerevisiae
  CDS (1)..(516)
atgtctatatatctacacataaaattccgattattcctttgcatacctgatttgcccctcagaatccacaaccagacttttcaagaaggtcttttttgcccctttatccttcatggttttcaaaattttgtacaacgacttgcccttgtgaagctcgataccgttcgaggtcttttccactttctctgccttcttgatcacaggcttctccactttctttgcaggagttgccactggctggtgctggtgctgcttctgctgctgcttctgctgctgcttctgcttctgcttcttgttgcccttgtacaacgctttctggtacttctcgtcctcgctgatgcaagacgtgtgattcttgtaactcacgccatcttcaaacgtcttggagcaatctatgcatgtatagtacgcgttaggacatctataataatgcttttcggtattcttcttgggcacagtatcattacacacctcacagttgaacgtaaccatcctgtaataacaaatatttcttga

SEQ ID NO: 50 - protein, 171 aa, Saccharomyces cerevisiae
MSIYLHIKFRLFLCIPDLPLRIHNQTFQEGLFCPFILHGFQNFVQRLALVKLDTVRGLFHFLCLLDHRLLHFLCRSCHWLVLVLLLLLLLLLLLLLLLVALVQRFLVLLVLADARRVILVTHAIFKRLGAIYACIVRVRTSIIMLFGILLGHSIITHLTVERNHPVITNIS

SEQ ID NO: 51 - DNA, 47 bp, Artificial sequence
  primer
ggaattccagctgaccaccatgtctatatatctacacataaaattcc

SEQ ID NO: 52 - DNA, 47 bp, Artificial sequence
  primer
gatccccgggaattgccatgtcaagaaatatttgttattacaggatg

SEQ ID NO: 53 - DNA, 678 bp, Saccharomyces cerevisiae
  CDS (1)..(678)
atgaggttttctatgttaatcgggtttaatttattaactgccttgagcagcttctgtgctgccatatcagctaataatagcgacaatgtcgaacatgaacaggaagttgcggaggcggtagcgccaccttctattaatatagaggtgaaatatgatgtcgttgggaaggaatcagaaaatcatgattctttccttgagttttacgcggaggataccgctaccttagcctataatgttactaattgggaagatactaatatcacaatttttggtgtcaacggaacaattgttacatatccacatggttatcctgtggcggacattacaggtgcgagtattgggccttacgaaatggaggtcaacggaacttcaaaattcgggcaagacgttacgttaaatttaccggaaggacaatactttttaatcccatttttattagcttctaggttcgatgaaatcgtgagaattgcggcaccaccaaccctattcgaaattgttagcccacctatttcctttttcaacccacaatttttatcagttcaggtcatctttctagccatcatcggaggtgtaagttattactacatgaagtctaaaacaaatcaaagaccttccaagaagagtgccactgtcaaaaaagttgatgaatcatggttgccagaaacctataaaaaataa

SEQ ID NO: 54 - protein, 225 aa, Saccharomyces cerevisiae
MRFSMLIGFNLLTALSSFCAAISANNSDNVEHEQEVAEAVAPPSINIEVKYDVVGKESENHDSFLEFYAEDTATLAYNVTNWEDTNITIFGVNGTIVTYPHGYPVADITGASIGPYEMEVNGTSKFGQDVTLNLPEGQYFLIPFLLASRFDEIVRIAAPPTLFEIVSPPISFFNPQFLSVQVIFLAIIGGVSYYYMKSKTNQRPSKKSATVKKVDESWLPETYKK

SEQ ID NO: 55 - DNA, 44 bp, Artificial sequence
  primer
ggaattccagctgaccaccatgaggttttctatgttaatcgggt

SEQ ID NO: 56 - DNA, 46 bp, Artificial sequence
  primer
gatccccgggaattgccatgttattttttataggtttctggcaacc

SEQ ID NO: 57 - DNA, 753 bp, Saccharomyces cerevisiae
  CDS (1)..(753)
atgggattgactactaaacctctatctttgaaagttaacgccgctttgttcgacgtcgacggtaccattatcatctctcaaccagccattgctgcattctggagggatttcggtaaggacaaaccttatttcgatgctgaacacgttatccaagtctcgcatggttggagaacgtttgatgccattgctaagttcgctccagactttgccaatgaagagtatgttaacaaattagaagctgaaattccggtcaagtacggtgaaaaatccattgaagtcccaggtgcagttaagctgtgcaacgctttgaacgctctaccaaaagagaaatgggctgtggcaacttccggtacccgtgatatggcacaaaaatggttcgagcatctgggaatcaggagaccaaagtacttcattaccgctaatgatgtcaaacagggtaagcctcatccagaaccatatctgaagggcaggaatggcttaggatatccgatcaatgagcaagacccttccaaatctaaggtagtagtatttgaagacgctccagcaggtattgccgccggaaaagccgccggttgtaagatcattggtattgccactactttcgacttggacttcctaaaggaaaaaggctgtgacatcattgtcaaaaaccacgaatccatcagagttggcggctacaatgccgaaacagacgaagttgaattcatttttgacgactacttatatgctaaggacgatctgttgaaatggtaa

SEQ ID NO: 58 - protein, 250 aa, Saccharomyces cerevisiae
MGLTTKPLSLKVNAALFDVDGTIIISQPAIAAFWRDFGKDKPYFDAEHVIQVSHGWRTFDAIAKFAPDFANEEYVNKLEAEIPVKYGEKSIEVPGAVKLCNALNALPKEKWAVATSGTRDMAQKWFEHLGIRRPKYFITANDVKQGKPHPEPYLKGRNGLGYPINEQDPSKSKVVVFEDAPAGIAAGKAAGCKIIGIATTFDLDFLKEKGCDIIVKNHESIRVGGYNAETDEVEFIFDDYLYAKDDLLKW

SEQ ID NO: 59 - DNA, 44 bp, Artificial sequence
  primer
ggaattccagctgaccaccatgggattgactactaaacctctat

SEQ ID NO: 60 - DNA, 45 bp, Artificial sequence
  primer
gatccccgggaattgccatgttaccatttcaacagatcgtcctta

SEQ ID NO: 61 - DNA, 1215 bp, Saccharomyces cerevisiae
  CDS (1)..(1215)
atgcctaacaaagtgtttaacgtggccgttttcttcgttgtgttcagagagtgcttggaagcagtgattgttatttccgtgctgctatcgtttttgaaacaggcaatcggggaacatgaccgggcgctgtaccgtaaattaaggattcaggtttgggtcggtgtgttactcgggttcatcatttgtctggccatcggtgcaggtttcatcggtgcgtactattcgctgcagaaggatattttcggaagcgcggaagacttgtgggaaggtatcttttgtatgattgcgacgataatgatctcgatgatgggtattcctatgttgagaatgaataagatgcagagtaagtggagagtgaagattgcgcggtcgttggtggagattcctcaccgtaagagagactatttcaagattgggttcttgagtagaagatatgctatgttccttttgccgtttattactgtcttgagagaaggtttggaagctgttgtgttcgttgccggtgcaggtattaccacacagggctcgcacgcctctgcttacccattgcccgttgtggttggtttgatatgtggtggtcttgttgggtatttgttgtactatggtgcttcgaaatcctcgctgcagattttcttgattttgtctacttcgatcttgtacctgatctccgccggtcttttctctcgtggtgcgtggtactttgaaaattacagattcaaccttgccagtggtggtgatgcttccgaaggcggtgatggtaatgggtcttataacatcagaaaggccgtttaccatgtcaattgttgcaacccagaactggacaatgggtgggatatcttcaatgctttgcttggatggcagaacaccggctacttgtcatccatgctttgttacaacatctattggttggttcttatcattgtgttgagtttaatgatattcgaagaaaggcgtggtcacttgcctttcaccaaaaacttacaattgaaacacttgaacccaggatactggatcaagaacaagaaaaagcaggagttgacggaagagcaaaagagacaactgtttgccaagatggagaacatcaacttcaatgaagatggtgagatcaatgtgcaagagaactacgaacttcccgagcaaactaccagtcattcctcgtctcaaaacgtcgccacagacaaggaagtcctccacgttaaagccgactctctttga

SEQ ID NO: 62 - protein, 404 aa, Saccharomyces cerevisiae
MPNKVFNVAVFFVVFRECLEAVIVISVLLSFLKQAIGEHDRALYRKLRIQVWVGVLLGFIICLAIGAGFIGAYYSLQKDIFGSAEDLWEGIFCMIATIMISMMGIPMLRMNKMQSKWRVKIARSLVEIPHRKRDYFKIGFLSRRYAMFLLPFITVLREGLEAVVFVAGAGITTQGSHASAYPLPVVVGLICGGLVGYLLYYGASKSSLQIFLILSTSILYLISAGLFSRGAWYFENYRFNLASGGDASEGGDGNGSYNIRKAVYHVNCCNPELDNGWDIFNALLGWQNTGYLSSMLCYNIYWLVLIIVLSLMIFEERRGHLPFTKNLQLKHLNPGYWIKNKKKQELTEEQKRQLFAKMENINFNEDGEINVQENYELPEQTTSHSSSQNVATDKEVLHVKADSL

SEQ ID NO: 63 - DNA, 44 bp, Artificial sequence
  primer
ggaattccagctgaccaccatgcctaacaaagtgtttaacgtgg

SEQ ID NO: 64 - DNA, 44 bp, Artificial sequence
  primer
gatccccgggaattgccatgtcaaagagagtcggctttaacgtg

SEQ ID NO: 65 - DNA, 282 bp, Saccharomyces cerevisiae
  CDS (1)..(282)
atgagtctaccggagattttgcctttggaagtcatagataaaacaattaaccagaaagtgttgattgtgctgcagtcgaaccgcgagttcgagggcacgttagttggtttcgacgacttcgtcaacgttatactggaagacgctgtcgagtggcttatcgatcctgaggacgagagcagaaatgagaaagttatgcagcaccatggcagaatgcttttaagcggcaacaatattgccatccttgtgccaggcggcaaaaagacccctacggaggcgttgtaa

SEQ ID NO: 66 - protein, 93 aa, Saccharomyces cerevisiae
MSLPEILPLEVIDKTINQKVLIVLQSNREFEGTLVGFDDFVNVILEDAVEWLIDPEDESRNEKVMQHHGRMLLSGNNIAILVPGGKKTPTEAL

SEQ ID NO: 67 - DNA, 43 bp, Artificial sequence
  primer
ggaattccagctgaccaccatgagtctaccggagattttgcct

SEQ ID NO: 68 - DNA, 42 bp, Artificial sequence
  primer
gatccccgggaattgccatgttacaacgcctccgtaggggtc

SEQ ID NO: 69 - DNA, 3399 bp, Saccharomyces cerevisiae
  CDS (1)..(3399)
atggaaaaagaatcagtatacaacttagcactaaaatgtgctgagcggcaattgacctccatggaattttcgaacctttacaaggaattctttaatgaaaagttcccgtctttgattcaagaggaagaagaagatacaacaacaactgcaaatataaatgaggtcaagaaagcgtccgatttggtggatacacccagcaacaacacggctgctactgcagatactacacacttacacgaggctctagatattgtttgctccgattttgttaaaatattaaacctggagaagcctcttatcttggcagattatatcgttgaggtattgcttgtgaactacaactcagatatgataaaatgctttctgcctaaattgaattccgttaggaactccttgctattggcccattttttctccaaatcttgttcattctttgccaaattatcagatactttgataattgatcaagtacgcaaggatttgggcaacgtcatagtaccgaatatcttaagtctagacatgaatagtatgaataaagaattgattgccatagtatcaaagcttttgcaaacaactttaaaactctctccttcaccaattcttttaacttctgccggctgtaaaaatgggtcttttacgctactaaatcagttgtctcaaaccaacaagttactttttaaaagggtttctcagacttttgaagcaaaattacatttcaaagataccaagccatttttaaacaaagattccactaacgaattcgtaggttctccttcattaacctcccctcaatatatcccaagtccactttcttcaacaaaacctccaggatcagtcaattctgctgccaaatacaaagacatgaagcttcttcgttactataaaaacatttggctgaacaataaaattatcaattgggaaatatcgaacccagacttcctatcaaaatattctgcgattacttcttctatatttcaagagagctttaattcagttcaaaacttggaccagttactcacagacttgattgagacatcgtttacttgttttgctcaattcgttagcaataagcaatatcatcaggcaaattctaatttgactctgttagaaagaaagtgggtcatatttataacaaaacatctaccattattaatcctggaaaactcttcaagaagtcctcgtgtagtcacgaatgctctggataatattgacgaaaaagtcgttaaagcaatcagaatatacttcaccgaaaaagatgataacaaaaccaataatgaagatctatttgatgattatccatctacaagcttggatataagacacgattttatcaaagggttgattatgttaaatttacagcctgcgtccgttatcaacaattacttaagagaggaccaaatgatcgacaccagtattttacctacccgtgatgatttgtttgttcgtaatttgcaaggcattcaagaagtcgtccataataccaacagtttcatcatttcatccttagatactttagagttagaatcgataaccgaatcgatcacacatgattcgagtaacggactatttcaagtattacacaattttgaatctgtagctccgacaaaacaacgtgagatagtaaaagcctttttatctatatttgaagatgcaataaaagaattgaattataatagaatagccaagatatgtgctcttttgtttttcaacttttcacattcattgaccacaattctatcattttcttcgccagcagcactaatgaaaacattgataaaattcgttgatttgtctagaaatggcagaaatggctcaaacggtaatgatgaaagttcagaatatgaaacgataaatatatctttgtcattttcttgggcaattttactgataatcaacctaacacaaacatatggcatatctgtggtggatgtggcacttaagtatcctgaattgagcataaaaaattcctttataatcaatttcatttcaaatctacctaatgtctcagataagtactatttggaagaatcaaatgtgaatgattcagatatgctaacaaagtctcataataccgttcaaagctggctttgtgatctttttgttaatgggtccataacagatcaattgatccaaaatattgaaacaaggcaattggctaatctcataccatttattgttaaacaggttttgctatctgttgaaataggcgttttaacggatatttcaagtctgataggtggcttcgaatatttcttacaacctttactattagttgggctaatcaaaactttttattggctagaacaatttctttcttgcgtcaagaacgacacaatatctgaagatattttacaagggatattcaatttattgaatacacttttcaacccagtaactcttaacgaggattcgaaagcgttccacacggctgtactgaggttgaatgcaattccactactcaaagttctccgcaaatttagagttcagagccagtcaaattatggtatctactcttctgatgcccaaggtgatcctaacttagaacctttgatagccaaattagttgccgttcttaatgtatcacccgtttatgacgtcgatccaagaattatcaattcagagaacgattattctagaaagcagttgggttacggtaaattcctaattttgaacgaaaacccgattaacaagataatgacgaaccaaattaactcattctggagtctccacagcagcacatattataacttagattatctatttgagttaattgaattggttaccccaaaaagtttcctttttgatgttttgaaaacattagaatataaactagccacttatggggtccctggttctgaaaataagaggggatcattggattcagagcatgttttcgattatttcttctactttcttgtactatatgatgtgaaaaccgcggaggaagccagtcaactaatagaatatatggagaacgacgcaaaaaaaagtaagggggacgttgatataaagggagaagacttacatgagaaaaatgactcagctgaggtgaggcaagaaactcaaccaaaagctgaagctacccaagacgatgatttcgatatgctttttggcgagaatgatacaagcactcaagcttacgaagaagaagaagagaatgaggataacgacggcaataatagaacaaacaatgtaccaatgataaaagcagaagaaactcctagtaaaactaataagatatccattttaaagagacattcgtttgcggtacttctgcatgaaagaaaattattgaatgatttagctttggaaaacggcgaaataaccaagacagaaaatgagaaatttatcagttatcacgataagtacttgtgtatgctgaaaacatgcgtattctga

SEQ ID NO: 70 - protein, 1132 aa, Saccharomyces cerevisiae
MEKESVYNLALKCAERQLTSMEFSNLYKEFFNEKFPSLIQEEEEDTTTTANINEVKKASDLVDTPSNNTAATADTTHLHEALDIVCSDFVKILNLEKPLILADYIVEVLLVNYNSDMIKCFLPKLNSVRNSLLLAHFFSKSCSFFAKLSDTLIIDQVRKDLGNVIVPNILSLDMNSMNKELIAIVSKLLQTTLKLSPSPILLTSAGCKNGSFTLLNQLSQTNKLLFKRVSQTFEAKLHFKDTKPFLNKDSTNEFVGSPSLTSPQYIPSPLSSTKPPGSVNSAAKYKDMKLLRYYKNIWLNNKIINWEISNPDFLSKYSAITSSIFQESFNSVQNLDQLLTDLIETSFTCFAQFVSNKQYHQANSNLTLLERKWVIFITKHLPLLILENSSRSPRVVTNALDNIDEKVVKAIRIYFTEKDDNKTNNEDLFDDYPSTSLDIRHDFIKGLIMLNLQPASVINNYLREDQMIDTSILPTRDDLFVRNLQGIQEVVHNTNSFIISSLDTLELESITESITHDSSNGLFQVLHNFESVAPTKQREIVKAFLSIFEDAIKELNYNRIAKICALLFFNFSHSLTTILSFSSPAALMKTLIKFVDLSRNGRNGSNGNDESSEYETINISLSFSWAILLIINLTQTYGISVVDVALKYPELSIKNSFIINFISNLPNVSDKYYLEESNVNDSDMLTKSHNTVQSWLCDLFVNGSITDQLIQNIETRQLANLIPFIVKQVLLSVEIGVLTDISSLIGGFEYFLQPLLLVGLIKTFYWLEQFLSCVKNDTISEDILQGIFNLLNTLFNPVTLNEDSKAFHTAVLRLNAIPLLKVLRKFRVQSQSNYGIYSSDAQGDPNLEPLIAKLVAVLNVSPVYDVDPRIINSENDYSRKQLGYGKFLILNENPINKIMTNQINSFWSLHSSTYYNLDYLFELIELVTPKSFLFDVLKTLEYKLATYGVPGSENKRGSLDSEHVFDYFFYFLVLYDVKTAEEASQLIEYMENDAKKSKGDVDIKGEDLHEKNDSAEVRQETQPKAEATQDDDFDMLFGENDTSTQAYEEEEENEDNDGNNRTNNVPMIKAEETPSKTNKISILKRHSFAVLLHERKLLNDLALENGEITKTENEKFISYHDKYLCMLKTCVF

SEQ ID NO: 71 - DNA, 46 bp, Saccharomyces cerevisiae
ggaattccagctgaccaccatggaaaaagaatcagtatacaactta

SEQ ID NO: 72 - DNA, 45 bp, Saccharomyces cerevisiae
gatccccgggaattgccatgtcagaatacgcatgttttcagcata

SEQ ID NO: 73 - DNA, 1158 bp, Saccharomyces cerevisiae
  CDS (1)..(1158)
atgttacgagtttctgaaaatggtctacggtttctgctgaaatgccattcaacgaacgtaagcatgtttaataggcttctgagtactcaaataaaggaggggagaagttccatagatgatgctggcattatccccgatggaactattaacgaaaggccgaatcactacatcgagggaattactaaaggcagtgatctggacctcttggaaaaaggtataagaaaaactgacgaaatgacttccaattttacaaattatatgtacaagtttcacagattgccccccaactatggaagtaaccagctcattactatcgataaggaacttcaaaaggaactggatggggtaatgtcatccttcaaagctccgtgccggtttgtatttggttacggctcaggagttttcgaacaagcgggatattccaaaagtcatagcaaacctcaaatcgatataatcttgggcgtcacatatccatcacattttcactctattaatatgaggcagaatccgcaacattattcaagtttgaaatacttcggttccgagttcgtgtctaaatttcaacagatcggcgcaggcgtatattttaatccatttgcaaatataaatggacacgacgtaaaatatggggtggtttctatggaaacacttttaaaggacatagctacttggaatacattctatttagcaggacgactacaaaagcctgtaaaaatattgaagaatgatttgagagtgcaatattggaaccaattaaacttaaaagctgcagctactttggccaaacattacaccttagagaaaaataacaataagtttgacgaattccaattttacaaggagatcactgccttaagttatgcaggtgatattagatacaaactgggtggagaaaatcccgacaaagttaacaacattgttaccaaaaactttgaaagatttcaagagtattacaagccgatttacaaagaagtggtcctaaatgattcattttatcttccaaaagggttcacattaaagaatactcagagacttttgctcagccgtattagtaaatcaagtgcattacaaactattaaaggtgttttcacagctggaatcacaaagtcaattaagtatgcttgggccaaaaaactaaaatcgatgaggagaagctag

SEQ ID NO: 74 - protein, 385 aa, Saccharomyces cerevisiae
MLRVSENGLRFLLKCHSTNVSMFNRLLSTQIKEGRSSIDDAGIIPDGTINERPNHYIEGITKGSDLDLLEKGIRKTDEMTSNFTNYMYKFHRLPPNYGSNQLITIDKELQKELDGVMSSFKAPCRFVFGYGSGVFEQAGYSKSHSKPQIDIILGVTYPSHFHSINMRQNPQHYSSLKYFGSEFVSKFQQIGAGVYFNPFANINGHDVKYGVVSMETLLKDIATWNTFYLAGRLQKPVKILKNDLRVQYWNQLNLKAAATLAKHYTLEKNNNKFDEFQFYKEITALSYAGDIRYKLGGENPDKVNNIVTKNFERFQEYYKPIYKEVVLNDSFYLPKGFTLKNTQRLLLSRISKSSALQTIKGVFTAGITKSIKYAWAKKLKSMRRS

SEQ ID NO: 75 - DNA, 44 bp, Artificial sequence
  primer
ggaattccagctgaccaccatgagcattctatcatccacacaat

SEQ ID NO: 76 - DNA, 46 bp, Artificial sequence
  primer
gatccccgggaattgccatgttaactacttgagttttctttccagc

SEQ ID NO: 77 - DNA, 930 bp, Saccharomyces cerevisiae
  CDS (1)..(930)
atgtctgccgttttcaacaacgctaccctttcaggtctagtccaagcaagcacctactcacaaactttgcaaaatgtcgcccattaccaacctcaattgaatttcatggagaaatactgggccgcatggtacagttacatgaacaatgatgttttggccaccggtctaatgttctttttattgcatgaatttatgtatttctttagatgtttgccatggttcatcatcgaccaaattccatactttagaagatggaagttacaaccaactaagattccaagtgctaaggaacaactatactgtttgaaatccgttcttctatctcatttcttggtcgaggccatccctatctggaccttccacccaatgtgtgaaaaattaggtattactgtcgaagttccattcccatctttgaaaacaatggctctagaaattggtctattcttcgtcttggaagatacatggcattactgggctcaccgtctattccactacggtgtcttctacaagtacattcacaagcaacatcacagatacgctgctccattcggtctttctgctgaatatgctcatcctgctgaaactttgtctttgggttttggtaccgttggtatgccaattctttacgtcatgtacactggtaaattacacttgttcactctatgtgtatggatcaccctaagattattccaagctgttgactctcattctggttatgacttcccatggtctttgaacaagatcatgccattctgggctggcgctgaacaccacgatttgcatcatcactactttattggtaactacgcttcctctttcagatggtgggattactgtctagacactgaatctggtccagaagctaaggcctccagagaagaaagaatgaagaagagagctgaaaacaatgctcaaaagaagactaactaa

SEQ ID NO: 78 - protein, 309 aa, Saccharomyces cerevisiae
MSAVFNNATLSGLVQASTYSQTLQNVAHYQPQLNFMEKYWAAWYSYMNNDVLATGLMFFLLHEFMYFFRCLPWFIIDQIPYFRRWKLQPTKIPSAKEQLYCLKSVLLSHFLVEAIPIWTFHPMCEKLGITVEVPFPSLKTMALEIGLFFVLEDTWHYWAHRLFHYGVFYKYIHKQHHRYAAPFGLSAEYAHPAETLSLGFGTVGMPILYVMYTGKLHLFTLCVWITLRLFQAVDSHSGYDFPWSLNKIMPFWAGAEHHDLHHHYFIGNYASSFRWWDYCLDTESGPEAKASREERMKKRAENNAQKKTN

SEQ ID NO: 79 - DNA, 43 bp, Artificial sequence
  primer
ggaattccagctgaccaccatgtctgccgttttcaacaacgct

SEQ ID NO: 80 - DNA, 46 bp, Artificial sequence
  primer
gatccccgggaattgccatgttagttagtcttcttttgagcattgt

SEQ ID NO: 81 - DNA, 1404 bp, Saccharomyces cerevisiae
  CDS (1)..(1404)
atgcgaatctcaaaaaatagtcataagcggcaaagaacgaggctatatttcctcgttacatttattatttattcgataataccctgccgtgcggtactcgtgccttggctggatgatgacccatttgaagcaacgcttctagaaatgggggatgaaccatggagtaaggacatcctttcaagcacacctccgttacatccatctgaagttaccgaggataacaaaagcttaaaacaaaggggcaatgtaccgcaatatgtcatcgataatagccctctgctccatttatatagtgaagaaaagtactggccagctgatgttaaggattttgtaaaaagattccagttgagagaccacagtggggagaaaattatcaatgaacaccttcgtgacttaagtgacttacaagagtattattcggtagagttagagaacggaacgtggggccgagtatccagtgaaggtacatatatgacaagtttagatgattttgataagggccctgactggttgttgggtgaacaaccagaatatggtacaggtcacataaagaaagcaccagcagttctttttgtcgttgacaaaggaaatggttgggtagacgcgttctggttttatttctaccccttcaattggggtccttatattatgggctccggaccatggggaaatcatgtaggggactgggaacattctttagtacgattctataaaggagaaccacaatatctatggatgagtgcgcatgggggtggtagtgcctataagttcgaagccattgagaaaatcaaaagattgcgtcgtgttgacggtaaattgacaaacgaggttattaagaagcctttaatatttagtgcaagaggcacacatgcacattatgcatcagtcggtcaacatgcgcacgatgttccgtttttctttatgccattgagtgactttactgatagagggccattatgggatccttctttaaactattatgcctatacagtgactgtgggggaaaaaatgacaccatgcggcgctgaagaaactaaaatgggactagaatggctatcgttcaaaggcgcttggggcgataaacaattaagacctagggatcccagacaaaaatggtgcccatttcaatggaaatatattgacggaccaaaaggtccactattcaaaaatatggaaagggtttctttatgccaaagatttaaatggtggaatttttggaagggctgcccggcaagaagatatataaaaagaggggaaggtttggatgcagaaaagaatgatcttgtgggtgacaattgtggtatcttgctgtacaacataaggccaaagtggctgcgtagcatactccgttttttgacgtggaggggaagcgtatgtttcattatggactactttacagggtaa

SEQ ID NO: 82 - protein, 467 aa, Saccharomyces cerevisiae
MRISKNSHKRQRTRLYFLVTFIIYSIIPCRAVLVPWLDDDPFEATLLEMGDEPWSKDILSSTPPLHPSEVTEDNKSLKQRGNVPQYVIDNSPLLHLYSEEKYWPADVKDFVKRFQLRDHSGEKIINEHLRDLSDLQEYYSVELENGTWGRVSSEGTYMTSLDDFDKGPDWLLGEQPEYGTGHIKKAPAVLFVVDKGNGWVDAFWFYFYPFNWGPYIMGSGPWGNHVGDWEHSLVRFYKGEPQYLWMSAHGGGSAYKFEAIEKIKRLRRVDGKLTNEVIKKPLIFSARGTHAHYASVGQHAHDVPFFFMPLSDFTDRGPLWDPSLNYYAYTVTVGEKMTPCGAEETKMGLEWLSFKGAWGDKQLRPRDPRQKWCPFQWKYIDGPKGPLFKNMERVSLCQRFKWWNFWKGCPARRYIKRGEGLDAEKNDLVGDNCGILLYNIRPKWLRSILRFLTWRGSVCFIMDYFTG

SEQ ID NO: 83 - DNA, 46 bp, Saccharomyces cerevisiae
ggaattccagctgaccaccatgcgaatctcaaaaaatagtcataag

SEQ ID NO: 84 - DNA, 45 bp, Saccharomyces cerevisiae
gatccccgggaattgccatgttaccctgtaaagtagtccataatg

SEQ ID NO: 85 - DNA, 486 bp, Saccharomyces cerevisiae
  CDS (1)..(486)
atgccacaagtacagtcgtggtttcctgttcagaaacaaccgacgctagcggtaacatttacaccattaccacaactgtcccatgctcatctaccactgccaccatcacatcttgtgacgaaaacggatgccatgttccagcaccaactgctaccgacgcaactgcaaccgtttcctccaaatcatacaccactgttactgttactcactgtgacaacaatggctgtaacaccaagactgtcacttctgaatgttctaaagaaactgcagcaaccaccatttctccaaaatcatacactactgttaccgttactcactgtgacgacaacggctgtaacaccaagactgtcacttccgaggcttccaaacaaacatcattggccactagcacagtcaccaagtctgctgctccaacttctcatactgctgcttccagcaccttcactggtattgtcgttcaatccgaaggtatggctgctggtttga

SEQ ID NO: 86 - protein, 161 aa, Saccharomyces cerevisiae
MPQVQSWFPVQKQPTLAVTFTPLPQLSHAHLPLPPSHLVTKTDAMFQHQLLPTQLQPFPPNHTPLLLLLTVTTMAVTPRLSLLNVLKKLQQPPFLQNHTLLLPLLTVTTTAVTPRLSLPRLPNKHHWPLAQSPSLLLQLLILLLPAPSLVLSFNPKVWLLV

SEQ ID NO: 87 - DNA, 43 bp, Artificial sequence
  primer
ggaattccagctgaccaccatgccacaagtacagtcgtggttt

SEQ ID NO: 88 - DNA, 43 bp, Artificial sequence
  primer
gatccccgggaattgccatgtcaaaccagcagccataccttcg

SEQ ID NO: 89 - DNA, 2841 bp, Saccharomyces cerevisiae
  CDS (1)..(2841)
atgagactcttcatcggtagaagatcacggtcgattgtaatatcttccaacaactactgtttatccttccagcgtttgcgcagcataccaggtgccagttctcagcagcgtcaattaagtaaaactcctagcgtaacaatcaagtcctaccctgacacagatctttcaagtgatagtaactatctcgaagtcaaaagttgcatatttaatggattattagggctcgtttgtcttaatggtgatatatatgttgccgtcatatctggtgttcagaatgttgggtttcctcgatggaaactgatagatcatcaagttaggccttcggagagcatttataaagtattggatgttgacttttacagcttagaaaatgatgttttcgactacctcctctgcgagagatcagagcaaaactatgataaattgattcatgagcatccttgcggccccctgaaaaaactgtttagtgatggaacattctactattctagagatttcgacatctctaatatcgtgaaaaaccatggtttatcacataacttagaatataccgtagataatcaagatttatcatttatttggaatgctaacttagcaagtgaggtaatcaactggagaagcaagatttcaaatgaggagaaacaactttttgccaacgcagggttcttaacatttgtaattcggggttattgcaagacagcattaatagaagacggcccaaatacagcctctataaccattatttccagaatttcgactgagagcaagcaggatacgctagaattggagggtattagtgaagatgggagagtgtcgctatttgttgagacagaaattgtagtaaccacagaaaagtttattttttcttatactcaagtgaacggaagcattcctcttttttgggaatctgtagaaagtcaactgttgtatggaaaaaaaattaaggtaacaaaagattctattgaagctcagggagcttttgacaggcattttgataatttaacctcaaagtatggtgttgtgagtatcgttaatatcataaaacctaaaagcgaatcacaagaaaagttagcactgacgtacaaggattgtgctgaatcaaagggaataaaaataacaaatatagaatacagctcaagcgttctgacaaagtctccccacaaattactttatttattaaaacaggatatttacgagtttggagcgtttgcctatgatatctctaggggcatctactttgcaaaacaaacgggggtattaagaataagcgcatttgattcaattgaaaaacctaacacagttgaaaggttagtgagcaaggaggtacttgaattaaccacaaatgaaattgatgtatttgaattgacttccccattcttggacgcacatgataagctatggtcagaaaactattactggcttgatcgaacgtatactaagcacacgaagaattctggtaaatatacaaaggtttattcgaagttatttggttcccgagttagattatacgacccgctccatatctacatctctcagtatttaaagcaattaaggtcaaaatatacgtttgagaaagacatctcaatttttgcaggtacatttaatataagtggtaaaattccaaaagatgatataaaagattggatatttccaaaatcaatgtccaaggaggatgaaatggctgatctttatgttatcggattagaagaagtggtagaacttaccccaggtcatatgcttgctaccgatccatatgtccgacaattttgggagaagaagatattaacactattaaatgggcccggacgcaaaaaaaaatatatccgtttatggagtacacagttgggtggtattttactattattattcatgaatgaaacggaatattccaaggtaaagcatattgagggggatgttaaaaaaaccgggtttggaggaatggcttctaataaaggagctgtcgcggttagttttaaatactcagctacaagattttgcgtactagtatctcatttagcggcaggcttagaaaatgttgaacaaaggcataatgattataagacgattgcgaaaagcatacgattttctaaaggattacgaataaaggatcacgatgcaattatttggatgggcgatttcaattacagaatattgatgtcaaacgaagatgttagacgaaaaattgtttctaaagaatatgccagcctatttgaaaaggatcaacttaatcaacaaatgatcgcaggtgagtcttttccatatttccatgaaatggcgattgatttcccacctacctataaattcgacccaggaactaaaaactacgacacgagcgaaaaaatgagaataccagcatggactgataggattttaagtaggggagaagtactagaacagttagaatataaatgctgtgaagatatactattttccgatcatcggcccgtatatgccatatttagggctagagtgactgtagtggatgaacaaaaaaagactactttgggtacgcaaatctacgagaagattatggaaaggctagagggattggatgatgatgagaaaattgcagttttgagtgatgatgcatttgttatcgaaagttttgagggcagtgattcgatagctggccctacgcattctccgacaccaattcccgagcccaaaagaggtagaaagttaccaccacctagttcggatttaaaaaaatggtggattggaagtgggaagcaagttaaagtagttcttgacgtagacccggccgtttacatgattaatcctaaaagagatcccaatccattcgttgagaacgaagatgagccactttttatagaaaggtaa

SEQ ID NO: 90 - protein, 946 aa, Saccharomyces cerevisiae
MRLFIGRRSRSIVISSNNYCLSFQRLRSIPGASSQQRQLSKTPSVTIKSYPDTDLSSDSNYLEVKSCIFNGLLGLVCLNGDIYVAVISGVQNVGFPRWKLIDHQVRPSESIYKVLDVDFYSLENDVFDYLLCERSEQNYDKLIHEHPCGPLKKLFSDGTFYYSRDFDISNIVKNHGLSHNLEYTVDNQDLSFIWNANLASEVINWRSKISNEEKQLFANAGFLTFVIRGYCKTALIEDGPNTASITIISRISTESKQDTLELEGISEDGRVSLFVETEIVVTTEKFIFSYTQVNGSIPLFWESVESQLLYGKKIKVTKDSIEAQGAFDRHFDNLTSKYGVVSIVNIIKPKSESQEKLALTYKDCAESKGIKITNIEYSSSVLTKSPHKLLYLLKQDIYEFGAFAYDISRGIYFAKQTGVLRISAFDSIEKPNTVERLVSKEVLELTTNEIDVFELTSPFLDAHDKLWSENYYWLDRTYTKHTKNSGKYTKVYSKLFGSRVRLYDPLHIYISQYLKQLRSKYTFEKDISIFAGTFNISGKIPKDDIKDWIFPKSMSKEDEMADLYVIGLEEVVELTPGHMLATDPYVRQFWEKKILTLLNGPGRKKKYIRLWSTQLGGILLLLFMNETEYSKVKHIEGDVKKTGFGGMASNKGAVAVSFKYSATRFCVLVSHLAAGLENVEQRHNDYKTIAKSIRFSKGLRIKDHDAIIWMGDFNYRILMSNEDVRRKIVSKEYASLFEKDQLNQQMIAGESFPYFHEMAIDFPPTYKFDPGTKNYDTSEKMRIPAWTDRILSRGEVLEQLEYKCCEDILFSDHRPVYAIFRARVTVVDEQKKTTLGTQIYEKIMERLEGLDDDEKIAVLSDDAFVIESFEGSDSIAGPTHSPTPIPEPKRGRKLPPPSSDLKKWWIGSGKQVKVVLDVDPAVYMINPKRDPNPFVENEDEPLFIER

SEQ ID NO: 91 - DNA, 44 bp, Artificial sequence
  primer
ggaattccagctgaccaccatgagactcttcatcggtagaagat

SEQ ID NO: 92 - DNA, 46 bp, Artificial sequence
  primer
gatccccgggaattgccatgttacctttctataaaaagtggctcat

SEQ ID NO: 93 - DNA, 3105 bp, Saccharomyces cerevisiae
  CDS (1)..(3105)
atgtctgccagaaaacgcaagtttaatagtctcaaaccgctagacaccttgaacagctctcgtgccagctctccaaggtcctctgcttctctaccgcccaaaagatataacacttttcgtaaggatccgaaaatcgttgatcatctaaacaatgcttctacaaaggatttcttaccagttttgagtatgaacagcgagagtaagaggcagatcgaattgtcggataatgatgttgataataatgatgaaggtgaaggcgtcaacagtggctgttcagatcaagattttgaacctttgcaaagctctcctttgaaaagacactcatcactcaaaagcacttccaatggtcttttgttccaaatgtctaataatctggggaatggttcaccggaaccggcagtagcgagcacttctccaaatggctcaattatttccactaaactaaatttgaacggccaattttcttgcgttgattcgaaaacattgcgaatttatcggcataaagcaccatgcataatgacttttgtctcagatcataatcatccgaaattttcattgtattttcaacaatcggtgatctacaattcacaagttaatctgcttgatgatgttgaattgataattttagataagaagaactcttttatggctataattttaaaagatctgaaaaaggtcaagatgatactagacgtgaataactcttcaatcaacattaacacgaacatcttgatatggtccactgcaagctccgcttcaaataaaaaaataaagtctattaaaagattcctgttgatgtcatattcttcgtcgataaaagtcgaaattttagatcataaagagcagattttggaaagactaaaacatctgattcatcctatttcttcgtcatcaccttcattgaacatggaaagggcaataaactccactaaaaatgcattcgactctttaagacttaaaaaaactaaactttctactaatgatgatgaaagtccgcaaattcatactcatttcttatcaaacaaacctcatggtttgcaatccttaacaaaaaggactcgtattgccagccttgggaaaaaagagcattcaatatctgttccaaaatcgaatatttcaccctcagatttctacaacactaacgggacagaaactttacaatcccacgcagtttcacaactaagacgttcaaatagatttaaagatgtttcggatccagcaaactcaaattcaaattcagaatttgatgatgcaactacggaatttgaaacaccagaactgtttaaacctagcctctgttacaaattcaacgatggttcaagctatactataacaaatcaagatttcaagtgtcttttcaataaggattgggttaatgatagcattttggatttttttacaaaattttacattgaatcatctattgaaaagtcaattatcaaaagagagcaagttcacttaatgtcctcttttttttacacgaaactaattagtaatccagcagattattattctaatgtaaaaaagtgggttaacaatactgatttgttttctaaaaagtacgttgttataccaattaacataagttatcattggtttagttgcattataacaaacttggatgcgatcttggattttcatcaaaacaaagataaaaacgatgccatcaactccgatgagatttctataaataatcctctggttaatattttgactttcgactcgttgaggcaaactcattcaagagaaattgatccaataaaagaatttctcatatcctatgcacttgataaatattcaattcaactggataaaacacaaatcaaaatgaaaacgtgtccagttccacaacaacctaatatgagcgattgtggtgttcatgttattttgaatattagaaaattttttgaaaatccggtggaaacaattgatgtatggaagaattctaagattaaaagtaagcacttcaccgcaaaaatgattaataaatattttgataaaaatgaaagaaatagtgcgagaaagaatttaaggcatactctaaaactcttacaactcaattacatcagctatctgaaaaaagaaaatttatatgaagaagttatgcaaatggaggagaaaaaaagcaccaatatcaacaataatgaaaattacgacgatgacgatgaagaaattcaaatcattgaaaatatagatcaaagcagtaaagataataacgcgcagttaacctcggaacctccctgctcacgatcatccagtatttcaacaacagaaagagagccgacagagttgcataattccgtagtacgacagcccaccggtgaaataataactgataatgaagatcccgttcgcgctgcttctccagaaacagcatccgtttctcctcccatacgtcacaatattttaaagagttcatctcctttcatatcagaaagtgcgaatgaaactgaacaagaagaatttacgtcaccatactttggaaggccgtctttaaagacgagggctaagcagtttgaaggcgtttcgtcaccaataaaaaacgatcaagccctgtcatccacccatgatattatgatgccgtcgcctaaacctaaaaggatttacccaagcaaaaaaatcccacaactttcctcgcatgttcaatctctatcgactgattctatggaacgccaatctagtcccaataataccaacattgtaatttcagatacagaacaagattcgaggttaggagtgaattctgaaagtaaaaatactagtggtattgttaacagggatgactcggacgtcaatttaattggtagttcactacctaatgtagcggaaaaaaatcatgacaacactcaggaaagtaatggtaataatgacagtcttggtaaaatacttcaaaatgttgacaaagaactgaacgaaaagttggttgatattgatgatgtggcatttagtagtccaactaggggtattccaagaaccagcgcgacaagcaagggatcaaatgcacaacttctctctaattatggagatgaaaataaccagtctcaagattctgtttgggatgagggcagagataatcctatactcttggaagatgaagacccttga

SEQ ID NO: 94 - protein, 1034 aa, Saccharomyces cerevisiae
MSARKRKFNSLKPLDTLNSSRASSPRSSASLPPKRYNTFRKDPKIVDHLNNASTKDFLPVLSMNSESKRQIELSDNDVDNNDEGEGVNSGCSDQDFEPLQSSPLKRHSSLKSTSNGLLFQMSNNLGNGSPEPAVASTSPNGSIISTKLNLNGQFSCVDSKTLRIYRHKAPCIMTFVSDHNHPKFSLYFQQSVIYNSQVNLLDDVELIILDKKNSFMAIILKDLKKVKMILDVNNSSININTNILIWSTASSASNKKIKSIKRFLLMSYSSSIKVEILDHKEQILERLKHLIHPISSSSPSLNMERAINSTKNAFDSLRLKKTKLSTNDDESPQIHTHFLSNKPHGLQSLTKRTRIASLGKKEHSISVPKSNISPSDFYNTNGTETLQSHAVSQLRRSNRFKDVSDPANSNSNSEFDDATTEFETPELFKPSLCYKFNDGSSYTITNQDFKCLFNKDWVNDSILDFFTKFYIESSIEKSIIKREQVHLMSSFFYTKLISNPADYYSNVKKWVNNTDLFSKKYVVIPINISYHWFSCIITNLDAILDFHQNKDKNDAINSDEISINNPLVNILTFDSLRQTHSREIDPIKEFLISYALDKYSIQLDKTQIKMKTCPVPQQPNMSDCGVHVILNIRKFFENPVETIDVWKNSKIKSKHFTAKMINKYFDKNERNSARKNLRHTLKLLQLNYISYLKKENLYEEVMQMEEKKSTNINNNENYDDDDEEIQIIENIDQSSKDNNAQLTSEPPCSRSSSISTTEREPTELHNSVVRQPTGEIITDNEDPVRAASPETASVSPPIRHNILKSSSPFISESANETEQEEFTSPYFGRPSLKTRAKQFEGVSSPIKNDQALSSTHDIMMPSPKPKRIYPSKKIPQLSSHVQSLSTDSMERQSSPNNTNIVISDTEQDSRLGVNSESKNTSGIVNRDDSDVNLIGSSLPNVAEKNHDNTQESNGNNDSLGKILQNVDKELNEKLVDIDDVAFSSPTRGIPRTSATSKGSNAQLLSNYGDENNQSQDSVWDEGRDNPILLEDEDP

SEQ ID NO: 95 - DNA, 44 bp, Artificial sequence
  primer
ggaattccagctgaccaccatgtctgccagaaaacgcaagttta

SEQ ID NO: 96 - DNA, 44 bp, Artificial sequence
  primer
gatccccgggaattgccatgtcaagggtcttcatcttccaagag

SEQ ID NO: 97 - DNA, 1080 bp, Saccharomyces cerevisiae
  CDS (1)..(1080)
atgcagcgtcttcaatgggataaagatattctatttttaatttttaaggtgatcttaattttttgttggttctttttcagttttttgtcaagcgaaaaactacagtttctacagaaaaacacgtcaagctacagtataagaacggattgtgaagaactcggtggagaacatagaaacagacaaaaaatcatggattactttaatatcaagcagaattactacacggggaacttcgtgcaatgtttgcaggaaatagagaagtttagcaaggtcacagataacaccttattattctacaaggcgaaaacccttttagctctaggccaatatcaatcacaagatcctacctctaagcttggcaaggtactagacttgtacgtccagttcttagatacaaaaaacattgaagaattagaaaatttgttaaaggataaacagaattcaccatatgaattatatctgttagccacggctcaagctatcttgggtgacttagataaaagtttggagacatgtgtagaagggattgacaatgacgaagcagaagggactacagaattattgctgcttgccatcgaagtcgctttgttaaacaacaacgtttcgaccgcgtccaccatctttgataactacactaatgctattgaggatactgtttccggtgacaacgaaatgattttaaacctggctgaatcgtacattaaatttgccacaaacaaagaaacggcaacatccaacttttactactatgaagagctatctcaaacctttcctacttggaaaactcaattgggattgctcaatttgcatttacagcaaagaaacatagctgaagctcagggtattgtcgagctattactatctgactactatagcgtcgaacaaaaagaaaacgccgtattgtacaaacctactttcttagcaaaccaaattacgcttgctcttatgcaaggtcttgatactgaagatttaacaaatcaattggttaaattggatcacgaacatgcattcatcaagcatcaccaagaaattgacgcaaaattcgatgaattagtgaggaaatatgatacgtccaactga

SEQ ID NO: 98 - protein, 359 aa, Saccharomyces cerevisiae
MQRLQWDKDILFLIFKVILIFCWFFFSFLSSEKLQFLQKNTSSYSIRTDCEELGGEHRNRQKIMDYFNIKQNYYTGNFVQCLQEIEKFSKVTDNTLLFYKAKTLLALGQYQSQDPTSKLGKVLDLYVQFLDTKNIEELENLLKDKQNSPYELYLLATAQAILGDLDKSLETCVEGIDNDEAEGTTELLLLAIEVALLNNNVSTASTIFDNYTNAIEDTVSGDNEMILNLAESYIKFATNKETATSNFYYYEELSQTFPTWKTQLGLLNLHLQQRNIAEAQGIVELLLSDYYSVEQKENAVLYKPTFLANQITLALMQGLDTEDLTNQLVKLDHEHAFIKHHQEIDAKFDELVRKYDTSN

SEQ ID NO: 99 - DNA, 43 bp, Artificial sequence
  primer
ggaattccagctgaccaccatgcagcgtcttcaatgggataaa

SEQ ID NO: 100 - DNA, 45 bp, Artificial sequence
  primer
gatccccgggaattgccatgtcagttggacgtatcatatttcctc

SEQ ID NO: 101 - DNA, 963 bp, Saccharomyces cerevisiae
  CDS (1)..(963)
atgttgggaaaagaagaagaacagcaatatggccagaatggtaagggaatggaaaatgaactaccctttatgaagaggccttggtttaaaaaggcttatgaaaatgctattgaatttcatgaaaaagacgaattgctggatgcaagagacaggctggagttatcgaaggcctatagatccattgctaaagctgagatgtggggtggttggcttgggttttcagctgtatttttaactccatttgcctatcgttactacaagaccaaggctattaaaggtgttaaggtgccgaggaattttgtcttgggtgtaatggctttattttttgctacaaattttgctggtaggtccatgtatacacgacagttgaacgaacgtgaccccacaggtgttttgaaggataactattccaacaaatatggtgacaacgactttggagcctttcaacatgatcaaacaaaagaaattccgagaaatcaaaggcagtacaatatgatgcgcttattagattcaggctccccctcaaggtggtcgatgtacttttacataacgtaccaaaatccggagagaagattgccagacccgaaagtcaaactgcagcaaatgaaaaaaggcggagtttttaacggctcgccctttatgaaccaaagggatcctataggattgtatcgtaataagggtagaaaatctcctgacccaattgaaggagagcaaaacgacagtcctgttctgtcttcctgggaaaaaatcaggaacggcgacaacagttcgtcttcatcatgggaaaatataaggaacaccagtagagatcagtcgcaggaatcagatgcttcagtggatcatgaatccgatatatttatctcaggattttctgacgatggtaatgctaccgataattcctcttctgatgacaaatatcagcgtttactgcagagcgggagatatggtgggaaccgctcctag

SEQ ID NO: 102 - protein, 320 aa, Saccharomyces cerevisiae
MLGKEEEQQYGQNGKGMENELPFMKRPWFKKAYENAIEFHEKDELLDARDRLELSKAYRSIAKAEMWGGWLGFSAVFLTPFAYRYYKTKAIKGVKVPRNFVLGVMALFFATNFAGRSMYTRQLNERDPTGVLKDNYSNKYGDNDFGAFQHDQTKEIPRNQRQYNMMRLLDSGSPSRWSMYFYITYQNPERRLPDPKVKLQQMKKGGVFNGSPFMNQRDPIGLYRNKGRKSPDPIEGEQNDSPVLSSWEKIRNGDNSSSSSWENIRNTSRDQSQESDASVDHESDIFISGFSDDGNATDNSSSDDKYQRLLQSGRYGGNRS

SEQ ID NO: 103 - DNA, 44 bp, Artificial sequence
  primer
ggaattccagctgaccaccatgttgggaaaagaagaagaacagc

SEQ ID NO: 104 - DNA, 42 bp, Artificial sequence
  primer
gatccccgggaattgccatgctaggagcggttcccaccatat

SEQ ID NO: 105 - DNA, 1629 bp, Saccharomyces cerevisiae
  CDS (1)..(1629)
atggcaggagcaacatcaagtataattcgggaaaatgattttgaggacgagcttgcggagagtatgcagtcatataatagagaaactgcagacaaattggctttgactaggaccgagagtgtaaagccagaaccggagataaccgctccgcctcactcacgcttttcccgttctttcaagacagttttaatagctcagtgcgctttcactgggtttttctccacaatagcaggtgccatctactatccagttctgagcgttatagaaagaaaattcgatattgacgaggaattggtgaatgtcactgttgtagtatattttgtatttcagggtcttgcccccacattcatgggcgggtttgccgattcactgggcaggagaccggtggtgcttgtcgcaatcgtcatttattttggtgcctgcatcggtcttgcttgtgctcaaacgtatgctcagatcattgtgctaagatgtctacaagccgccggtatttcacccgtgattgcgattaacagcggaataatgggagatgttactactagagccgagcgcggcgggtacgttggatatgttgctggatttcaagttctaggttctgcgttcggagcccttatcggtgccggattatcatctagatggggatggagagccatcttttggttcttagcaattggatctggcatttgcttcctagcctcgtttttaattttgccagaaacaaagaggaacatatccgggaatggttctgtcaccccaaaatcatacttaaatagagctcccattcttgttttgccaacagtaagaaaatcattgcatttggataatccagattacgaaacattggaactgcccacgcaactaaatctactggcgcccttcaagattttgaaagcttatgaaatttgtatacttatgctagtcgctggattacaatttgccatgtatactacgcaccttacggcgttatccacagctttgagtaaacaatatcacttgactgttgcaaaggtaggattatgctaccttccctccggtatctgcacattatgtagtattgtcattgctggaagatatttgaattggaattacaggcgcagattaaaatattaccaaaattggttgggcaagaagagatcaaagcttttagaagaacacgacaacgaccttaatttggtgcaacgtatcatagaaaatgatcccaaatacacctttaatatcttcaaggcgaggttgcaacccgcatttgttaccttgcttttaagcagtagcggattttgtgcgtacggatggtgcattactgtcaaagcccctttagcggccgttctttgcatgagtggatttgcgtcgctgttttccaattgcattttgactttttcaacaactctaatagttgatctttttcccacgaagacatctacggctacgggatgtttaaaccttttcagatgcattctatctgctgtgtttatagctgcattgagtaaaatggtagaaaaaatgaaattcggaggtgtttttacatttttgggggctttaacctcctcgtcatcgatcctcttatttattctcttgagaaaaggtaaagaattagcctttaagaggaaaaagcaagaactgggagtaaattaa

SEQ ID NO: 106 - protein, 542 aa, Saccharomyces cerevisiae
MAGATSSIIRENDFEDELAESMQSYNRETADKLALTRTESVKPEPEITAPPHSRFSRSFKTVLIAQCAFTGFFSTIAGAIYYPVLSVIERKFDIDEELVNVTVVVYFVFQGLAPTFMGGFADSLGRRPVVLVAIVIYFGACIGLACAQTYAQIIVLRCLQAAGISPVIAINSGIMGDVTTRAERGGYVGYVAGFQVLGSAFGALIGAGLSSRWGWRAIFWFLAIGSGICFLASFLILPETKRNISGNGSVTPKSYLNRAPILVLPTVRKSLHLDNPDYETLELPTQLNLLAPFKILKAYEICILMLVAGLQFAMYTTHLTALSTALSKQYHLTVAKVGLCYLPSGICTLCSIVIAGRYLNWNYRRRLKYYQNWLGKKRSKLLEEHDNDLNLVQRIIENDPKYTFNIFKARLQPAFVTLLLSSSGFCAYGWCITVKAPLAAVLCMSGFASLFSNCILTFSTTLIVDLFPTKTSTATGCLNLFRCILSAVFIAALSKMVEKMKFGGVFTFLGALTSSSSILLFILLRKGKELAFKRKKQELGVN

SEQ ID NO: 107 - DNA, 44 bp, Saccharomyces cerevisiae
ggaattccagctgaccaccatggcaggagcaacatcaagtataa

SEQ ID NO: 108 - DNA, 46 bp, Saccharomyces cerevisiae
gatccccgggaattgccatgttaatttactcccagttcttgctttt

SEQ ID NO: 109 - DNA, 3216 bp, Saccharomyces cerevisiae
  CDS (1)..(3216)
atgctagacgatgataagggcacggccatgcatccacatataacgccgttcacgcctgagtactcaaatgaattactgcgaagggtccaggacctgtaccacgaagatatcaagcactactatccgcagctaaaactggagaagctgctggaccttctggagcatacagagtacctattcgagttatatctagattcaatccatcacgataggcccaacgatgcactgacagcgtttatcattggatgctactacgtgttcttaattattccacaatctttgcagttccaaacacgaaacaagtcctacagcatctatacagatctaaaaaagatgtatgagaatgaaatgaacatgaccaatgttgtgcttatggtgaagaaagaaatcggtgtggtcctagatgaatcggttaaacacggggccggtattgagcacagaatcaccaagaagagggcattttcagttccagctgacgatctttcaggtcaggtagcttcactatcacttgacaccgcggcaccgcaagatcatggcctcaaaggcacgtttactgaagacgacgcagaacaatcttcacctgtttggacagcaccaaacttagagcccaacgaccaattgaaactggctttattgcccgaagtgataccaacgccagcttttcgtgagcctgaaagaaagacaagtgttccagtgagaccatctgttttattggaagatgtaccctccatataccacgaggatgacactagtttcgcatctttgaacccaccatttcgagaaataaccgcagatagatcagtaactcatcgaaaggattcttaccattctgtttatatggtggatagcggcaacctcaaggaagacaatgatgatctgttcaacgttgagaatgatggcttcatccagagtttggatattttacaaaagcagagtataatcacagcaccagaattgtttagtattttatcgaatcgcgttgaacgtgaaaaggttttactcatcgacttgagaataccacaaagatctgcaataaatcacattgtggctccgaacttagtgaatgtggatccaaacttgttgtgggacaagcagacgaacacacctatctacaaggatgacatattggaacatttactgaaggagaatgagaattttataaaccgtaataaatttgattacattgtttactatactgatgtgaagaccttcatgactataaattttgattatgcatttatttttttttatttgatgctgacttctcagaagactcctttaacaactgtacctactaccctcttaggtgggtacgaaaaatggaagaaaactctgcattcgtatgcccaggagtatcatatctctattgaagattacttgtacagaccttactcacagaaggcgcgcttacaacaggagcagcagcagcagcagcagcagccggattctcaggactctttttccgctaaggaatcatctacaaaagttcctgagcctccctcctggaagccccctgacctgcctataaggttaaggaaacgtcctccacctccaccgcctgtatcaatgcccacaaccccagaaattccacctcctctgccccctaagataatggttcattcacaagtcagttctatctctcgaaagccgccaataccagcaaagcagcatgtcaaaaaggaacaacttaactccaatgaaattattcaaagaaaaagacagcaccagcatcagcattacgaccaacaaatattacaaccgcaaagggcgtacaatattccaactattgaacgcagtccaaacgtatacgtttcgttgtccatcacgggactaagaaatttgggcaatacatgttacattaatagtatgatacaatgtctattcgctgcgaaaacattccggacactcttcatttcatccaaatataagagctatctgcaaccaataaggagcaacggatctcattattctcctaaactttcgaattcactaagtatgctcttcaacaagatgtatctaaatggtggttgctcagttgtcccaacaggatttctcaaagttatcaatcaattgcgtcccgatttgaaaattcctgatgaccaacaggatacccaagagttcctaatgatacttttagacaggttacacgatgaactttccgaccaacagcatgtagcgaacgattatccgaatttattattgtataatgcagatgccctaaaggtttcaaacaacgaatataagcactggtttgacaaaaatgtcattggtaatggtatatctcctattgatgacatttttcaagggcaaatggagaacagcttacaatgtaaaaggtgcggttacactactttcaactatagcacattttatgttttatcactggctataccaagacgttccatgaagttgagtaaacttggtaggtctactgagaaaagagttaagttagaggattgtattaatatgtttacaagcgatgaggtactctctggtgaaaatgcatgggattgcccacgctgtggccccacggcgtctgtgtctacatctgtgtctgcattagagaatgagccatccattgttaagagtaaaaagaaaaaaagtcggttttttacattacatacaggaaccaagcgtcgtcatctcgacttttttggagacggtattactgagggccataatagcaataataataatacgacaatctttgaacgagaaaggtccagatcacccttcaggatgttgggtggtagtgggaagaggtccagttccagtacaccgttcagtactggtggtaatgatagtaacaactcgagtgattacaagaacaaaaaattgacaacagtgaaaacgataaattttgtaactttaccaaaaatcttagtcatccatttatcgagattttattacgatttgaccaagaaaaataacaccgtcgtaacatatccattgatactaaacattatattgaaaaacaatgacactatgaaatataagctatttggagtggttaaccatacaggcacattaatcagtggccattacacgtcactggtgaataaagaccttgaacacaatgtgaatattgggcgttctaaatggtactatttcgacgatgaggttgtcaaggcagataggaaacatggatctgataaaaacttgaaaatttcaagtagcgatgtctacgtattgttttatgaaagggtttatgactag

SEQ ID NO: 110 - protein, 1071 aa, Saccharomyces cerevisiae
MLDDDKGTAMHPHITPFTPEYSNELLRRVQDLYHEDIKHYYPQLKLEKLLDLLEHTEYLFELYLDSIHHDRPNDALTAFIIGCYYVFLIIPQSLQFQTRNKSYSIYTDLKKMYENEMNMTNVVLMVKKEIGVVLDESVKHGAGIEHRITKKRAFSVPADDLSGQVASLSLDTAAPQDHGLKGTFTEDDAEQSSPVWTAPNLEPNDQLKLALLPEVIPTPAFREPERKTSVPVRPSVLLEDVPSIYHEDDTSFASLNPPFREITADRSVTHRKDSYHSVYMVDSGNLKEDNDDLFNVENDGFIQSLDILQKQSIITAPELFSILSNRVEREKVLLIDLRIPQRSAINHIVAPNLVNVDPNLLWDKQTNTPIYKDDILEHLLKENENFINRNKFDYIVYYTDVKTFMTINFDYAFIFFYLMLTSQKTPLTTVPTTLLGGYEKWKKTLHSYAQEYHISIEDYLYRPYSQKARLQQEQQQQQQQPDSQDSFSAKESSTKVPEPPSWKPPDLPIRLRKRPPPPPPVSMPTTPEIPPPLPPKIMVHSQVSSISRKPPIPAKQHVKKEQLNSNEIIQRKRQHQHQHYDQQILQPQRAYNIPTIERSPNVYVSLSITGLRNLGNTCYINSMIQCLFAAKTFRTLFISSKYKSYLQPIRSNGSHYSPKLSNSLSMLFNKMYLNGGCSVVPTGFLKVINQLRPDLKIPDDQQDTQEFLMILLDRLHDELSDQQHVANDYPNLLLYNADALKVSNNEYKHWFDKNVIGNGISPIDDIFQGQMENSLQCKRCGYTTFNYSTFYVLSLAIPRRSMKLSKLGRSTEKRVKLEDCINMFTSDEVLSGENAWDCPRCGPTASVSTSVSALENEPSIVKSKKKKSRFFTLHTGTKRRHLDFFGDGITEGHNSNNNNTTIFERERSRSPFRMLGGSGKRSSSSTPFSTGGNDSNNSSDYKNKKLTTVKTINFVTLPKILVIHLSRFYYDLTKKNNTVVTYPLILNIILKNNDTMKYKLFGVVNHTGTLISGHYTSLVNKDLEHNVNIGRSKWYYFDDEVVKADRKHGSDKNLKISSSDVYVLFYERVYD

SEQ ID NO: 111 - DNA, 42 bp, Saccharomyces cerevisiae
ggaattccagctgaccaccatgctagacgatgataagggcac

SEQ ID NO: 112 - DNA, 46 bp, Saccharomyces cerevisiae
gatccccgggaattgccatgctagtcataaaccctttcataaaaca

SEQ ID NO: 113 - DNA, 423 bp, Saccharomyces cerevisiae
  CDS (1)..(423)
atgatggaattcaaagtgtcaccattgacaaagattatttctctgtcaggattcctcgcattgggattccttttggtcatactaagctgcgcattattccataattactacccactattcgatattttgatctttttgcttgccccaataccaaacacaattttcaatgcaggaaataaatatcacacatctgacttcatgtccgattcatcaaacactggccaagatctggctcacttccttacaggaatgctggtgacaagcggtatagcactccctgttgttttctatcattgccaattgattggccatttgagttgtatcatgtgcatgatcggtggtcttatcatatattctagtattgttatttttaaatggtttttcaaaaaagatttcaacgaagatgattccctttttggttaa

SEQ ID NO: 114 - protein, 140 aa, Saccharomyces cerevisiae
MMEFKVSPLTKIISLSGFLALGFLLVILSCALFHNYYPLFDILIFLLAPIPNTIFNAGNKYHTSDFMSDSSNTGQDLAHFLTGMLVTSGIALPVVFYHCQLIGHLSCIMCMIGGLIIYSSIVIFKWFFKKDFNEDDSLFG

SEQ ID NO: 115 - DNA, 44 bp, Artificial sequence
  primer
ggaattccagctgaccaccatgatggaattcaaagtgtcaccat

SEQ ID NO: 116 - DNA, 45 bp, Saccharomyces cerevisiae
gatccccgggaattgccatgttaaccaaaaagggaatcatcttcg

SEQ ID NO: 117 - DNA, 3114 bp, Saccharomyces cerevisiae
  CDS (1)..(3114)
atggcatgcctctcaagaattgatgcaaatttgctccaatattatgaaaaacctgaacccaataatacggttgatttatacgtcagtaataacagtaataataacgggctgaaagaaggagataagtccatctctacaccagttcctcagccttacggaagtgaatattccaattgtttgttattgagtaactctgagtatatctgttaccatttttcctcaagatcaacattgttgacattttatcctttgagtgacgcataccatgggaagacaattaatatacacttaccaaatgcttctatgaatcagagatacactttaacgatacaagaagtggaacagcaattactggttaatgttatcttaaaagatggttcgtttttaacgttacaactacccctaagtttcctattttcatcggccaacactctcaatggagagtggtttcatctccaaaatccctacgactttacagttagagttcctcatttccttttctatgtatcaccccagttctcagttgtttttttggaagatggcggtttgttgggtttaaaaaaagttgacggcgtacattacgagcctttactattcaatgataattcatacttgaaaagcctaacgcgatttttttctaggagttctaaatcggattacgatagtgtgattagttgtaaattattccatgaaagatacttaattgtgttgactcagaattgccacttgaaaatttgggatttaacttcatttactttaatacaagattatgatatggtttcacagtcagattcagacccaagccattttagaaaagtggaagctgtaggggaatacctttccttgtataacaatactctagttacattgttgcctttggaaaatgggctttttcaaatgggcaccttgttggttgattcaagcggtattttgacttatacttttcaaaataacatccccactaatctttcagcttctgctatttggtcaattgtagatttagttctaacgagaccattggagttgaatgtcgaggctagttatttaaatttgatcgttttatggaaaagtggcactgctagcaagttacagatactaaacgtaaatgatgaaagtttcaaaaactatgaatggatagaatcagttaacaaatccttagtagatttgcaatccgaacatgatttggatatcgttacaaagactggagatgttgagaggggtttctgtaatttgaaatcaagatatggtacccaaatttttgaacgtgcacagcaaatattgagtgaaaataagattattatggctcataacgaagatgaagaatatttggctaatttagaaacaatattgagagacgtaaaaaccgcattcaacgaggcttcttctataacactttatggcgatgaaattattctcgtcaattgtttccaaccgtataatcattccctttacaagctgaatactactgtggagaattggttttataatatgcactctgaaactgatggttctgaattgttcaagtatttaaggacattgaatggttttgcttctactttgtcaaatgatgttcttagatccatttctaagaagtttcttgatataataacaggagagctgcctgattctatgactaccgtagaaaaatttacggacattttcaaaaattgcctagaaaatcaatttgaaatcacaaatctaaagattcttttcgacgaattaaactcttttgatatacccgttgttttaaatgatttaatcaataaccaaatgaagcctggtatattttggaaaaaggatttcatctctgcaatcaaattcgatggtttcacaagtataatttccctagaatctcttcaccagttactttccatacattatcgtattactttacaagtattgttaacattcgttctgttcgatcttgataccgaaattttcggacagcatatatctacattattggatttgcattataagcaatttttattgttaaacctttatagacaagataagtgtctgttggcggaagttcttctcaaggattcttctgaattctctttcggtgtcaaattttttaactacggccaactcattgcctatatcgattccttaaactctaatgtttacaatgcttccatcactgaaaattctttctttatgacgtttttccgctcatatatcattgaaaacacatctcataagaatataaggttctttctcgagaacgttgaatgccccttctacttacgccacaacgaggtgcaagaatttatgtttgccatgacgttatttagttgtggtaatttcgatcaatcctatgaaatttttcaactacacgattatccggaggctatcaatgataaattgccgacattcttagaagaccttaagagtgaaaactatcacggtgatagtatatggaaagatcttttgtgcacctttacagttccatataggcattctgcattctattatcaattatctctcttatttgatagaaataacagccaagaatttgctttgaaatgtatatctaagtcagcagaatattcattaaaagaaattcagattgaagaactgcaagacttcaaagaaaaacagcatattcattatttaaatcttttaatccacttcagaatgtttgaagaagtcttggatgttttgagattgggtcacgagtgtctttccgacacagtaagaacaaattttctccaattattattacaggaagacatatattcacgagattttttcagcacacttctgcgcttgtgtaacgcacattcagacaatggcgagctatatcttcgtacagtagatattaaaatagtggatagtattctgtcacaaaatctacggagtggtgattgggagtgttttaagaaactttattgttttagaatgttgaacaaaagcgagagggctgctgcagaagtactgtaccagtacatattaatgcaagctgatcttgatgttattcgaaagagaaaatgttacctaatggtcatcaacgttttatctagctttgatagtgcatacgatcaatggattctaaacggaagtaaagtggttactttaactgatttaagagatgagttacgaggtctatag

SEQ ID NO: 118 - protein, 1037 aa, Saccharomyces cerevisiae
MACLSRIDANLLQYYEKPEPNNTVDLYVSNNSNNNGLKEGDKSISTPVPQPYGSEYSNCLLLSNSEYICYHFSSRSTLLTFYPLSDAYHGKTINIHLPNASMNQRYTLTIQEVEQQLLVNVILKDGSFLTLQLPLSFLFSSANTLNGEWFHLQNPYDFTVRVPHFLFYVSPQFSVVFLEDGGLLGLKKVDGVHYEPLLFNDNSYLKSLTRFFSRSSKSDYDSVISCKLFHERYLIVLTQNCHLKIWDLTSFTLIQDYDMVSQSDSDPSHFRKVEAVGEYLSLYNNTLVTLLPLENGLFQMGTLLVDSSGILTYTFQNNIPTNLSASAIWSIVDLVLTRPLELNVEASYLNLIVLWKSGTASKLQILNVNDESFKNYEWIESVNKSLVDLQSEHDLDIVTKTGDVERGFCNLKSRYGTQIFERAQQILSENKIIMAHNEDEEYLANLETILRDVKTAFNEASSITLYGDEIILVNCFQPYNHSLYKLNTTVENWFYNMHSETDGSELFKYLRTLNGFASTLSNDVLRSISKKFLDIITGELPDSMTTVEKFTDIFKNCLENQFEITNLKILFDELNSFDIPVVLNDLINNQMKPGIFWKKDFISAIKFDGFTSIISLESLHQLLSIHYRITLQVLLTFVLFDLDTEIFGQHISTLLDLHYKQFLLLNLYRQDKCLLAEVLLKDSSEFSFGVKFFNYGQLIAYIDSLNSNVYNASITENSFFMTFFRSYIIENTSHKNIRFFLENVECPFYLRHNEVQEFMFAMTLFSCGNFDQSYEIFQLHDYPEAINDKLPTFLEDLKSENYHGDSIWKDLLCTFTVPYRHSAFYYQLSLLFDRNNSQEFALKCISKSAEYSLKEIQIEELQDFKEKQHIHYLNLLIHFRMFEEVLDVLRLGHECLSDTVRTNFLQLLLQEDIYSRDFFSTLLRLCNAHSDNGELYLRTVDIKIVDSILSQNLRSGDWECFKKLYCFRMLNKSERAAAEVLYQYILMQADLDVIRKRKCYLMVINVLSSFDSAYDQWILNGSKVVTLTDLRDELRGL

SEQ ID NO: 119 - DNA, 43 bp, Saccharomyces cerevisiae
ggaattccagctgaccaccatggcatgcctctcaagaattgat

SEQ ID NO: 120 - DNA, 45 bp, Artificial sequence
  primer
gatccccgggaattgccatgctatagacctcgtaactcatctctt

SEQ ID NO: 121 - DNA, 909 bp, Saccharomyces cerevisiae
  CDS (1)..(909)
atgttttccagattatccagatctcactcaaaagcattaccgattgctctaggtacagttgctatagcagctgctaccgcattctattttgcaaaccgtaaccaacattcctttgtcttcaatgaatctaataaagtgttcaaaggtgatgacaaatggatcgacttgccaatatctaaaatagaggaggaatcccacgacaccagaaggtttacttttaagctgcctaccgaagactcagaaatggggttggtcctagcatctgctctgtttgctaaatttgtcacaccaaagggatccaatgtggtgagaccatacactcctgtgagtgatctttcccagaagggtcacttccagctggtcgtcaagcattatgaaggtggtaaaatgacctcacatttatttggtcttaaaccaaatgacaccgtttctttcaagggtcctattatgaaatggaagtggcaacctaatcagttcaagtcaatcaccttgttaggtgccggtaccggtatcaaccctctgtaccaattagctcatcatatagttgaaaacccaaacgacaagaccaaagttaacttgctatatgggaacaagactcctcaggacattttactaaggaaggaactggatgcgttgaaggaaaagtatcctgacaagttcaatgttacttactttgttgacgacaagcaagatgaccaagactttgatggtgaaattagtttcatctccaaagattttattcaggagcatgttccaggtccaaaggaaagcacacatttgtttgtctgcggtcccccaccatttatgaacgcttactcaggtgagaagaagtcacctaaggaccaaggtgaattgatcggtatcttgaacaatttgggctactccaaggaccaagttttcaaattttaa

SEQ ID NO: 122 - protein, 302 aa, Saccharomyces cerevisiae
MFSRLSRSHSKALPIALGTVAIAAATAFYFANRNQHSFVFNESNKVFKGDDKWIDLPISKIEEESHDTRRFTFKLPTEDSEMGLVLASALFAKFVTPKGSNVVRPYTPVSDLSQKGHFQLVVKHYEGGKMTSHLFGLKPNDTVSFKGPIMKWKWQPNQFKSITLLGAGTGINPLYQLAHHIVENPNDKTKVNLLYGNKTPQDILLRKELDALKEKYPDKFNVTYFVDDKQDDQDFDGEISFISKDFIQEHVPGPKESTHLFVCGPPPFMNAYSGEKKSPKDQGELIGILNNLGYSKDQVFKF

SEQ ID NO: 123 - DNA, 44 bp, Artificial sequence
  primer
ggaattccagctgaccaccatgttttccagattatccagatctc

SEQ ID NO: 124 - DNA, 46 bp, Artificial sequence
  primer
gatccccgggaattgccatgttaaaatttgaaaacttggtccttgg

SEQ ID NO: 125 - DNA, 264 bp, Saccharomyces cerevisiae
  CDS (1)..(264)
atggaaaacgataagggccaattagtcgaactttacgttccaagaaaatgttctgctaccaacagaatcatcaaggctgatgaccacgcatctgttcaaatcaacgtcgctaaggttgatgaagaaggacgtgctatcccaggtgagtacgttacctacgctttgtccggttacgttagatccagaggtgaatctgatgattctttgaaccgtttggctcaaaacgatggtttgttaaagaacgtctggtcttactcacgttaa

SEQ ID NO: 126 - protein, 87 aa, Saccharomyces cerevisiae
MENDKGQLVELYVPRKCSATNRIIKADDHASVQINVAKVDEEGRAIPGEYVTYALSGYVRSRGESDDSLNRLAQNDGLLKNVWSYSR

SEQ ID NO: 127 - DNA, 44 bp, Artificial sequence
  primer
ggaattccagctgaccaccatggaaaacgataagggccaattag

SEQ ID NO: 128 - DNA, 44 bp, Artificial sequence
  primer
gatccccgggaattgccatgttaacgtgagtaagaccagacgtt

SEQ ID NO: 129 - DNA, 378 bp, Saccharomyces cerevisiae
  CDS (1)..(378)
atgaatttattcttcgtcttcttcttcgtcttcttctggagtgacttggtagaaggccaatctgtattcgttggtcttggtagagacaaatctgatccagtctctcaattggttcttcttcaagtacttctttgtcaagtacttcaagtacttaccagagaacttggcagtggaaacaacagtaacaacggtaccatcttcagtgacagtgacagcgttacccaagttaccgacagcaccttcgaccttgatgtggtcgatcaagtacttagcgtaggaagctgggtcgaagacaccgttttcagttggagaagagacatcgacggtaaaggtcttggcaatcttttgctttctggaagtctatatcaaaaaaattaa

SEQ ID NO: 130 - protein, 125 aa, Saccharomyces cerevisiae
MNLFFVFFFVFFWSDLVEGQSVFVGLGRDKSDPVSQLVLLQVLLCQVLQVLTRELGSGNNSNNGTIFSDSDSVTQVTDSTFDLDVVDQVLSVGSWVEDTVFSWRRDIDGKGLGNLLLSGSLYQKN

SEQ ID NO: 131 - DNA, 46 bp, Artificial sequence
  primer
ggaattccagctgaccaccatgaatttattcttcgtcttcttcttc

SEQ ID NO: 132 - DNA, 48 bp, Saccharomyces cerevisiae
gatccccgggaattgccatgttaatttttttgatatagacttccagaa

SEQ ID NO: 133 - DNA, 1431 bp, Saccharomyces cerevisiae
  CDS (1)..(1431)
atgatagcttccaaaagctccttattagttactaaatcgcgcataccctctctatgctttcctttgataaagaggtcctatgtgtcaaagactccgacacactctaacacggctgctaatctgatggttgaaactccggccgccaatgccaacggcaatagtgtgatggcacctcctaactcaatcaattttctacagacacttcccaagaaggaactattccaactgggattcatcggtattgcgaccttgaacagcttcttcctgaacacgatcattaagttgttcccttacatccccatcccagtaataaaattcttcgtctcttctttatactgtggcggtgagaactttaaagaggtcatcgaatgcggcaaacgtctgcagaagagaggtatatcgaacatgatgctttcattaactattgaaaattccgaaggtacaaagagtttgtccagtactccagtagaccaaattgtcaaggaaacaatcagctctgtccacaacatcctactgcccaatattattggccagctggaatctaagccaatcaatgacattgctccaggttatatcgctctaaaaccctctgctttggtcgataaccctcacgaggttctgtacaatttcagtaatcccgcctacaaggctcaaagggatcagctgatcgagaactgctctaagattacaaaagagatttttgaactaaatcaatctttgttaaagaagtaccctgaaagaaaggccccatttatggtttccactattgacgctgagaagtatgatttgcaggagaatggtgtttacgaattacagagaatcttatttcaaaaattcaatcccacttcatctaaactgatatcatgtgtcggtacttggcagttgtacctaagggactctggtgaccatattttgcacgaattgaagctggcccaagaaaacggctataagcttgggctgaaactggttcgtggtgcttatattcattctgaaaaaaaccgtaaccaaattatctttggcgataaaacgggcactgacgaaaattacgatcgtatcatcactcaagttgtcaatgatttaatcatcaatggcgaggattcttattttggtcacttggttgtcgcctctcataattaccaatcccaaatgctcgttactaatttgctaaaatctacccaagacaactcttatgccaaatcgaacattgtgttggggcaattactaggtatggcagataatgttacctatgacctaattaccaaccatggcgctaaaaacataatcaagtatgtcccatggggcccaccattggaaactaaagattatcttttgagaagattgcaagaaaacggggatgctgtgagatctgataatggctggccattaatcaaggccatagcaaagtcgattccaaaaagagtaggcctatga

SEQ ID NO: 134 - protein, 476 aa, Saccharomyces cerevisiae
MIASKSSLLVTKSRIPSLCFPLIKRSYVSKTPTHSNTAANLMVETPAANANGNSVMAPPNSINFLQTLPKKELFQLGFIGIATLNSFFLNTIIKLFPYIPIPVIKFFVSSLYCGGENFKEVIECGKRLQKRGISNMMLSLTIENSEGTKSLSSTPVDQIVKETISSVHNILLPNIIGQLESKPINDIAPGYIALKPSALVDNPHEVLYNFSNPAYKAQRDQLIENCSKITKEIFELNQSLLKKYPERKAPFMVSTIDAEKYDLQENGVYELQRILFQKFNPTSSKLISCVGTWQLYLRDSGDHILHELKLAQENGYKLGLKLVRGAYIHSEKNRNQIIFGDKTGTDENYDRIITQVVNDLIINGEDSYFGHLVVASHNYQSQMLVTNLLKSTQDNSYAKSNIVLGQLLGMADNVTYDLITNHGAKNIIKYVPWGPPLETKDYLLRRLQENGDAVRSDNGWPLIKAIAKSIPKRVGL

SEQ ID NO: 135 - DNA, 44 bp, Saccharomyces cerevisiae
ggaattccagctgaccaccatgatagcttccaaaagctccttat

SEQ ID NO: 136 - DNA, 45 bp, Artificial sequence
  primer
gatccccgggaattgccatgtcataggcctactctttttggaatc

SEQ ID NO: 137 - DNA, 1827 bp, Saccharomyces cerevisiae
  CDS (1)..(1827)
atgcacactaactcacccttacgagcggataaccaagatctagaaactcaaccactgttgagaccaaacactgaagaaagccaactcctcaatgatgaagtgagaatcaacgttgcaaatgagacccttattaaatctcgttggcggagtataaagtgcttaattatatatctgctaggtattgttttattaagtttctttggcgtcagcatagtgcagtatattaggggacatgtgccgcccacagatgtgatagaaaagaatctagttcaagtaacaaatttcaaactggtggagtttcagcttgatggttggaaagataatatgggctctgacctgaacaatgatacaggtaagtatttgcaggtgtctatacactctcaaatttggttcgattatgacaaatggccaggaacggaaaatgactcggacgccagaagccaacgtgactggatacggtacatcaatgaaaaagttcttaaaaccatttgtatagatctgaataacgtgaccacattcgatggagatctagtgttcaagaataaactgggagatgttgttggcatggaacccatttgttttaatttggctcaccgacagattaataacctacagttcaaaattttagttaaaccgtctatttggaaaatcgtaaaagttttgaaaaaattttggaatagggattttgaatccttaaatataaaatcgaatttagatatgactatcttcaagagaaaatttggcacgaggtttaatttattgaaacttaatgacgaaatcttagattggaaagatattattgattgggaaaaaatatcggcaacgccccttcggatgattcaaaatatgatcgatggaatatctcttcaaggatttacattgcgggactccagttctgatggatttcatgccgatatgagactgaatccgatcacgattcttggaggggtggactggcttcaccttccgccaggcacgtcaatccctttcatcaattgggaaatcaagctaccggactgtaacggtgagcctgctatcgcaattccaaccttgtcttgctttaacgaaccgattaatctgcaccacgacaaggataatatcgtcgtctgtttacaaaatgaaattgaaggtcctctgcccgatgaactactataccaagaatgtcctcaaaatagtcttacaccaatgagccaaatagtgaatgcggtcctgaaccagaacgagactgttacgttcgcagcaagaggccatgtccttgaagatggtatagataataactcattgattccagcagacatgctggaggatattttccaagaagcatcgtttattcccattactaccaatgctacgtttaactccagtgaattgattcaagagtttcagatcaacgatcttcagctacggtgggcagcgcgcaaaaagctcagtcttgtggggacatttttaggattctttgatctatccttctacgagacgcaccagcaagaccgagttcgcatcgataccattcggggacagatcgatctgtaccataacgacatcaatttcttaaacttacccatgaagcaatggatcaactcttcatcgcacattctgcacgatgaggacacaggaaatacgcagatgaagcttcaatttgatctagaaaatgacgacatggaagtcgtcaatagcttggaactaacacgaaccctgaacgaaatactattccagggttttacagttattcactttaatgcgacgatagatgcgtcacttacgacggcattgggcccgtgggttctcaccgggttagccggagagggtgacactttggtcacgtga

SEQ ID NO: 138 - protein, 608 aa, Saccharomyces cerevisiae
MHTNSPLRADNQDLETQPLLRPNTEESQLLNDEVRINVANETLIKSRWRSIKCLIIYLLGIVLLSFFGVSIVQYIRGHVPPTDVIEKNLVQVTNFKLVEFQLDGWKDNMGSDLNNDTGKYLQVSIHSQIWFDYDKWPGTENDSDARSQRDWIRYINEKVLKTICIDLNNVTTFDGDLVFKNKLGDVVGMEPICFNLAHRQINNLQFKILVKPSIWKIVKVLKKFWNRDFESLNIKSNLDMTIFKRKFGTRFNLLKLNDEILDWKDIIDWEKISATPLRMIQNMIDGISLQGFTLRDSSSDGFHADMRLNPITILGGVDWLHLPPGTSIPFINWEIKLPDCNGEPAIAIPTLSCFNEPINLHHDKDNIVVCLQNEIEGPLPDELLYQECPQNSLTPMSQIVNAVLNQNETVTFAARGHVLEDGIDNNSLIPADMLEDIFQEASFIPITTNATFNSSELIQEFQINDLQLRWAARKKLSLVGTFLGFFDLSFYETHQQDRVRIDTIRGQIDLYHNDINFLNLPMKQWINSSSHILHDEDTGNTQMKLQFDLENDDMEVVNSLELTRTLNEILFQGFTVIHFNATIDASLTTALGPWVLTGLAGEGDTLVT

SEQ ID NO: 139 - DNA, 43 bp, Artificial sequence
  primer
ggaattccagctgaccaccatgcacactaactcacccttacga

SEQ ID NO: 140 - DNA, 43 bp, Artificial sequence
  primer
gatccccgggaattgccatgtcacgtgaccaaagtgtcaccct

SEQ ID NO: 141 - DNA, 1383 bp, Saccharomyces cerevisiae
  CDS (1)..(1383)
atgatgcttgaagggtatacggtacaacctccacagtctactttgataggtgacattgaaattcaggacgaaaatgcaaaccaagaagttaagaacgtactttaccaaggagttcaaaagggtataaaaaggctagaaaaaagacaaaggagggttgcattaggtgatgtaacctctcaaaaggcaaacaaaatacacaatgctatacataataaattccatcagacgaagaacaattttgaaatagagaacatacgctcatcggccttggtaaaagaacaacaacgagacgtaaggcatgaagatagcgactattttttaattgatagttctgaaggctcttctactgatgacgaacaagttaatgaagatgctattgatgatttgttaagtcgaagagtaaatgatcagcagattcaagccgatgaagtgtatgaagatttcgatggagaaatgcaagatgtcattgaagaggatgttgatagtcaaattgaaccactatcaccaataaacaacgatgaaattcagactgagctggacagggcgtttgaaaaatattttcggtcggttcccaatccgctggatgatgatacccatgatgttgtgatggttgtggagtacgcttccgacatattctattacttgagagaacttgaagtgaaatataggcctaatccctactatatgcaaaatcaagtagagcttacatggccgttcagacgaactatgatagattggctagttcaactgcattttagatttcaacttttaccagaaacgctatacctgacgattaatatagtggatagatttctgtcaaagaagaccgttactttgaacaggtttcaattggttggtgtatcggctttatttattgctgccaagtttgaagagattaactgccccactttggatgatctagtttacatgctggaaaatacatacactagagatgacattattagagcggaacagtatatgatagatactctggaatttgaaataggttggccaggacccatgccatttttaagaaggataagtaaagcagatgactatgacttcgaaccaagaacattagcaaagtacttattggaaactacaatagtagaacccaaactagtggctgcggcaccaagctggttagctgctggcgcgtattttctgagcagaacaattcttggttcaaatgattggtctttaaaacatgtattctactctggctatacatccagccaaataattcctttagcatcactgatattggagaattgcaagaacgcatctcgacgccatcattcaatttggaaaaaatactttgaccaaaagcattaccgctgttctcaaattgtagaagaatggattgtttcgacagaagcctaa

SEQ ID NO: 142 - protein, 460 aa, Saccharomyces cerevisiae
MMLEGYTVQPPQSTLIGDIEIQDENANQEVKNVLYQGVQKGIKRLEKRQRRVALGDVTSQKANKIHNAIHNKFHQTKNNFEIENIRSSALVKEQQRDVRHEDSDYFLIDSSEGSSTDDEQVNEDAIDDLLSRRVNDQQIQADEVYEDFDGEMQDVIEEDVDSQIEPLSPINNDEIQTELDRAFEKYFRSVPNPLDDDTHDVVMVVEYASDIFYYLRELEVKYRPNPYYMQNQVELTWPFRRTMIDWLVQLHFRFQLLPETLYLTINIVDRFLSKKTVTLNRFQLVGVSALFIAAKFEEINCPTLDDLVYMLENTYTRDDIIRAEQYMIDTLEFEIGWPGPMPFLRRISKADDYDFEPRTLAKYLLETTIVEPKLVAAAPSWLAAGAYFLSRTILGSNDWSLKHVFYSGYTSSQIIPLASLILENCKNASRRHHSIWKKYFDQKHYRCSQIVEEWIVSTEA

SEQ ID NO: 143 - DNA, 43 bp, Artificial sequence
  primer
ggaattccagctgaccaccatgatgcttgaagggtatacggta

SEQ ID NO: 144 - DNA, 45 bp, Artificial sequence
  primer
gatccccgggaattgccatgttaggcttctgtcgaaacaatccat

SEQ ID NO: 145 - DNA, 2328 bp, Saccharomyces cerevisiae
  CDS (1)..(2328)
atgtcatttgatagaccggaaatatacagtgctcctgttttacaaggagaatctcctaacgacgatgataatactgaaatcataaagtcctttaagaatttcattttggagttcagacttgactcgcaatttatttacagagatcagttaaggaacaacatccttgtgaagaattattctttaacggttaacatggagcatttgatcggatataacgaagacatatataagaaactatcagacgaaccttcagatatcattccattattcgaaaccgcgatcacacaagtggctaaaaggataagtattctaagcagagctcaatctgctaataacaatgacaaagatccagaaaatactagtatggatactgattctctcttattgaactctttaccaacatttcaattaattttaaactccaatgcaaatcagattccattgagagatttggattctgaacacgtctccaagattgtccgtttatcaggtattataatatccacgtcagttttatcttcccgtgccacgtacctttctataatgtgcagaaattgcagacacacaacatcaataacaatcaacaatttcaattctatcacaggcaataccgtcagtttaccacgttcttgcttatctacgattgagagtgaatcttctatggcaaacgagtcgaatattggtgatgaatcgaccaagaaaaattgtggacctgatccatatattattatccatgagtcttcaaagtttattgatcaacagtttttaaaattacaggaaatcccagaactggttccagtaggtgagatgcctagaaacttaacaatgacttgtgaccgatacctaacaaacaaagttattcctggtacgagagtcactatagtaggtatttattccatctataattctaaaaatggtgccggatccggaaggagcgggggtggaaatggaggaagtggtgttgctattagaacaccttatatcaaaatattaggtattcagtccgatgtagaaacctcctctatttggaattcagtaactatgtttactgaggaggaagaagaggaatttctacagctaagtagaaacccgaagctttatgaaattttgaccaactctattgccccctctatttttggtaatgaagatataaaaaaagccattgtatgtttattgatgggtggttccaagaagatattacccgatggtatgaggttaagaggtgatatcaatgtactattattaggtgatccaggtaccgccaaatctcaactattgaaatttgtggagaaagtgtcacctattgcggtatatacatctggtaagggatcttctgcagctgggttaactgccagtgtacaaagagatccgatgacaagagaattttatttggaaggtggtgctatggtgcttgccgatggtggtgttgtatgcatcgatgaattcgataaaatgagagatgaagatagagtggccattcatgaagctatggagcagcaaacaatctccatcgcaaaagctggtatcactacagtgctaaattctagaactagtgttttagcggctgctaatccgatatacggccggtatgatgatttgaagtctcctggtgacaacattgatttccaaactactattttatcccgttttgatatgatttttattgttaaggatgaccataatgaagaacgtgatatttcaatagctaaccacgttattaatattcatacaggaaatgctaatgctatgcaaaaccaacaagaggaaaatggcagtgaaattagtattgaaaagatgaaacgttacattacgtattgtagattgaaatgtgcaccaagactttcaccgcaggccgctgaaaaactgtcatcgaacttcgtcaccattaggaagcaattattaatcaacgaattagagtcaacggaaaggtcgtctattccaattaccattcgtcaattagaagctattattagaataacagaatcattagccaagttagaattaagtcctattgcacaggagagacatgttgacgaagctattagattgtttcaagcttccacaatggacgcagcgtctcaggatccaattggcggcttaaatcaagcaagcggaacatctttgtcagaaatccgtcgttttgaacaagaactaaaaagaagattacctataggctggtctacttcttatcaaactttgaggagagaatttgtagatacacatagattttctcaattagcactggataaggccttatatgccctagagaagcatgaaacaattcaattgagacaccagggacagaatatttacagaagtggtgtatga

SEQ ID NO: 146 - protein, 775 aa, Saccharomyces cerevisiae
MSFDRPEIYSAPVLQGESPNDDDNTEIIKSFKNFILEFRLDSQFIYRDQLRNNILVKNYSLTVNMEHLIGYNEDIYKKLSDEPSDIIPLFETAITQVAKRISILSRAQSANNNDKDPENTSMDTDSLLLNSLPTFQLILNSNANQIPLRDLDSEHVSKIVRLSGIIISTSVLSSRATYLSIMCRNCRHTTSITINNFNSITGNTVSLPRSCLSTIESESSMANESNIGDESTKKNCGPDPYIIIHESSKFIDQQFLKLQEIPELVPVGEMPRNLTMTCDRYLTNKVIPGTRVTIVGIYSIYNSKNGAGSGRSGGGNGGSGVAIRTPYIKILGIQSDVETSSIWNSVTMFTEEEEEEFLQLSRNPKLYEILTNSIAPSIFGNEDIKKAIVCLLMGGSKKILPDGMRLRGDINVLLLGDPGTAKSQLLKFVEKVSPIAVYTSGKGSSAAGLTASVQRDPMTREFYLEGGAMVLADGGVVCIDEFDKMRDEDRVAIHEAMEQQTISIAKAGITTVLNSRTSVLAAANPIYGRYDDLKSPGDNIDFQTTILSRFDMIFIVKDDHNEERDISIANHVINIHTGNANAMQNQQEENGSEISIEKMKRYITYCRLKCAPRLSPQAAEKLSSNFVTIRKQLLINELESTERSSIPITIRQLEAIIRITESLAKLELSPIAQERHVDEAIRLFQASTMDAASQDPIGGLNQASGTSLSEIRRFEQELKRRLPIGWSTSYQTLRREFVDTHRFSQLALDKALYALEKHETIQLRHQGQNIYRSGV

SEQ ID NO: 147 - DNA, 45 bp, Artificial sequence
  primer
ggaattccagctgaccaccatgtcatttgatagaccggaaatata

SEQ ID NO: 148 - DNA, 46 bp, Artificial sequence
  primer
gatccccgggaattgccatgtcatacaccacttctgtaaatattct

SEQ ID NO: 149 - DNA, 1449 bp, Saccharomyces cerevisiae
  CDS (1)..(1449)
atgggcggctatttggcgatcgtgttcattccccaaactaacacgaagagcatgagagagaaaaaacaaaagtgcttgaaacaggtaagacgtttatcattgatatcaccaaagaaatatataatgccggattctatttttgaacagccctttgtttactgtggtgtttgccacagaagaacatcgcatggagatccattgaggctgacctcatgtgctcatatcctctgttcgcagcattctccattaacatcaaaggtgtgtcctatatgccgttcgagcgatatctccatcattaaccttgtggaatctaaacagctgcctaccgacattaggattttttttgagccactgcccccacttttggagtcgttatataatgtttcccaattccaactgaatgggctttcgaaacagtgtcaatactatcaaaatcattgtttaaagttgagagaaaaatgtgcaagacaacagcagctgctatatcaggccaaaatagagttggattctatggcgattcttaagaaaagaatacaggaattagagtcagttttgaatcataacaatgtttcttcgatgtcagttggtgtgctaccaacaagaaatagccatcaaaatcattaccagccccctccaaccgttgatctgacagttgatgataatagtttagaagaattcgaagccaaatcctttattaaaaagttgaaaaaaaactcttctttgagaaattcttcaaaaaataacaatggaactgtcactccctctacaagtggtcgtgtaaataaaaaccagcctctctttatggagacattgaataatcctaatagaaatagcattcctcctcctggaatgaacccaaacgcaaatagtaatctacctaatatttcgactattgcagaatcaaccaatctgaacagattttcgttctctcctgtgcgtgttgcaaaaggcttcgatggaaagttgccaaatcttgacatcctcacgaataatggctctgtatcttccaaaaatatatcaagattatcttcagcttctctccaaccctcttcgcctctatcttcatcatcaaataggcttattttaccaaatagtaacctcaaagaattgcatcattcaaatacacctttaacaagtacctcgacgcagtttccctcagctttagaaaaattaaaaataacaaggaagagaaataatactatcagcggttcgaatagaataacacacaacttgagctcacacgtaagaagcagtggtcttgccttttcatcttcatcgaactcattgcaacaaagtaaactgccgaaatcaaatatactaaagcggtccaattcaactcagcaactgactaatacacatttgaagagtgataatcatctgccacctcgctcaagtaatactgtgttgggtagtagcaagaaaaacaataagtttagaaggattaggtaa

SEQ ID NO: 150 - protein, 482 aa, Saccharomyces cerevisiae
MGGYLAIVFIPQTNTKSMREKKQKCLKQVRRLSLISPKKYIMPDSIFEQPFVYCGVCHRRTSHGDPLRLTSCAHILCSQHSPLTSKVCPICRSSDISIINLVESKQLPTDIRIFFEPLPPLLESLYNVSQFQLNGLSKQCQYYQNHCLKLREKCARQQQLLYQAKIELDSMAILKKRIQELESVLNHNNVSSMSVGVLPTRNSHQNHYQPPPTVDLTVDDNSLEEFEAKSFIKKLKKNSSLRNSSKNNNGTVTPSTSGRVNKNQPLFMETLNNPNRNSIPPPGMNPNANSNLPNISTIAESTNLNRFSFSPVRVAKGFDGKLPNLDILTNNGSVSSKNISRLSSASLQPSSPLSSSSNRLILPNSNLKELHHSNTPLTSTSTQFPSALEKLKITRKRNNTISGSNRITHNLSSHVRSSGLAFSSSSNSLQQSKLPKSNILKRSNSTQQLTNTHLKSDNHLPPRSSNTVLGSSKKNNKFRRIR

SEQ ID NO: 151 - DNA, 41 bp, Artificial sequence
  primer
ggaattccagctgaccaccatgggcggctatttggcgatcg

SEQ ID NO: 152 - DNA, 47 bp, Artificial sequence
  primer
gatccccgggaattgccatgttacctaatccttctaaacttattgtt

SEQ ID NO: 153 - DNA, 813 bp, Saccharomyces cerevisiae
  CDS (1)..(813)
atggctatcgaaaatatatacattgccagacatggttacaggtcaaactggctaccaaagggaccatatccaccaccgcccaccggtattgataacgatgtcccgctttcggaacacggtgttgaacaggcacatgaactggcgaactatatctctaaattagatgtcaaaccagaaatgattttctcctccccattttaccgctgtttagaaactagtaaacccacagtggaggctttaaagattccattatatgtcgatcgtggtgtaggagaatggtataagcctgatagacccattatcccggagcctgctactcatgaagttatgagtaagttttttccaagcatgatctctccagactgggaacctagtattattcctagtaataagggtgaaacagaagaagatatttttgagaggtgccataaattctggcctgtctttattgacagagtggagagaaaatttccaaatgtaaagaccattatgatagttacccacgcagccactaaatccgctcttggtatgaacttgttgaaattctccagtgccaaagagcccattgataacaaaggcacctttataagaaatggaagttgtgctattgataaatttgagctggtgaaaggagaaaatgaaagtataccatttgaagagagagagtggaaacttacaatgaatggcaacacctcctttttaactaatggggaagaaatgaattggacgtttatgaatgcctttgaggctggttcagacgctgatatcaaagcgagaagagcagctgagagcggaaaactaaaaatggagtga

SEQ ID NO: 154 - protein, 270 aa, Saccharomyces cerevisiae
MAIENIYIARHGYRSNWLPKGPYPPPPTGIDNDVPLSEHGVEQAHELANYISKLDVKPEMIFSSPFYRCLETSKPTVEALKIPLYVDRGVGEWYKPDRPIIPEPATHEVMSKFFPSMISPDWEPSIIPSNKGETEEDIFERCHKFWPVFIDRVERKFPNVKTIMIVTHAATKSALGMNLLKFSSAKEPIDNKGTFIRNGSCAIDKFELVKGENESIPFEEREWKLTMNGNTSFLTNGEEMNWTFMNAFEAGSDADIKARRAAESGKLKME

SEQ ID NO: 155 - DNA, 45 bp, Artificial sequence
  primer
ggaattccagctgaccaccatggctatcgaaaatatatacattgc

SEQ ID NO: 156 - DNA, 45 bp, Artificial sequence
  primer
gatccccgggaattgccatgtcactccatttttagttttccgctc

SEQ ID NO: 157 - DNA, 1044 bp, Saccharomyces cerevisiae
  CDS (1)..(1044)
atggtttctgtggagtttttacaggagttaccaaaatgtgagcatcacttgcatttggaaggtactctagaacctgacctattgttcccattagctaaaagaaacgatataattctacctgaaggttttcctaaatcggtcgaggaattaaacgaaaagtataagaagtttcgtgatctgcaggatttcttagattactattatattggtactaatgtcttgattagtgaacaagatttctttgatttggcgtgggcctattttaaaaaagttcacaaacaaggcttggtccatgctgaagtgttttacgaccctcagtcacatacatctaggggcatctccatagaaacagtcactaaaggtttccaaagagcttgtgacaaagccttctctgaatttggtattacatccaagctaattatgtgtctgttaagacacattgaaccagaggaatgtttgaaaactatcgaagaagctaccccatttattaaagatggtactatctctgccttaggattagattctgctgagaaaccatttcccccacatttatttgttgaatgttacggaaaggccgcctcattgaataaagatttaaaactaactgcacacgcaggtgaagaaggccccgctcaattcgtctcggatgctttagacttgttgcaagtaacaagaatcgatcacggtatcaacagtcaatacgacgaggagttattggataggttgtcgcgcgaccagaccatgctaactatttgtcctctctccaacgtgaagctacaagtagtccaatccgtttcagagttaccactacaaaagtttcttgacagagatgttccattttctttaaattctgatgaccccgcctattttggtggttatatcttagatgtctacactcaagtttcgaaagatttcccacactgggaccatgaaacatggggtcgtatcgctaagaacgccattaaaggttcatggtgtgacgataaaagaaagaacggtttgttaagtagagtggacgaagtagtcactaaatattcgcattag

SEQ ID NO: 158 - protein, 347 aa, Saccharomyces cerevisiae
MVSVEFLQELPKCEHHLHLEGTLEPDLLFPLAKRNDIILPEGFPKSVEELNEKYKKFRDLQDFLDYYYIGTNVLISEQDFFDLAWAYFKKVHKQGLVHAEVFYDPQSHTSRGISIETVTKGFQRACDKAFSEFGITSKLIMCLLRHIEPEECLKTIEEATPFIKDGTISALGLDSAEKPFPPHLFVECYGKAASLNKDLKLTAHAGEEGPAQFVSDALDLLQVTRIDHGINSQYDEELLDRLSRDQTMLTICPLSNVKLQVVQSVSELPLQKFLDRDVPFSLNSDDPAYFGGYILDVYTQVSKDFPHWDHETWGRIAKNAIKGSWCDDKRKNGLLSRVDEVVTKYSH

SEQ ID NO: 159 - DNA, 44 bp, Artificial sequence
  primer
ggaattccagctgaccaccatggtttctgtggagtttttacagg

SEQ ID NO: 160 - DNA, 46 bp, Artificial sequence
  primer
gatccccgggaattgccatgctaatgcgaatatttagtgactactt

SEQ ID NO: 161 - DNA, 1056 bp, Saccharomyces cerevisiae
  CDS (1)..(1056)
atgttcaagagatttagcaaaaagaaggaggctccagaagacccaaaaaatttgattaatattgataagcctatcaaagaacttcctgcttcgatagctattccaaaagaaaaaccacttacaggtgagcaacaaaaaatgtatgacgaagtgctaaaacatttcagtaaccctgacttgaaggtttatacaagtgaaaaaaataagtcggaggatgatcttaaacccttagaggaagaagaaaaggcatggttgacaagagaatgttttttacgttacctaagggctactaaatgggtgctaaaagactgtatcgatagaatcaccatgactctagcgtggagaagagaattcggtattagtcatttaggtgaagagcatggtgataaaataactgctgacttggtggccgtcgagaacgaatcaggtaagcaggtgattttgggttacgaaaacgatgctagacctatcttatatttgaaaccgggcagacaaaatacaaagacttctcacagacaggtacagcacttggtcttcatgttggaaagagttatcgattttatgccagctggtcaagactctctagctttgctaatagactttaaagattaccctgatgttcctaaagtacctggcaatagtaaaatcccacctattggtgtagggaaagaagtgctgcatattctacaaactcattatccagaaagactaggaaaagcacttttgacgaatattccttggttagcatggactttcttgaagttaattcacccttttattgacccactgacccgtgaaaagctagtttttgatgaaccatttgttaaatatgtccctaagaacgaactagattcgttgtatggtggtgatctgaaattcaagtacaatcatgatgtttattggccagctctggtggaaaccgcgcgtgaaaaaagagatcattattttaagaggtttcaaagcttcggtggtattgtaggtttaagtgaggttgatttaagaggtactcatgaaaaacttctttacccagtaaaatcggaaagcagtaccgtgtaa

SEQ ID NO: 162 - protein, 351 aa, Saccharomyces cerevisiae
MFKRFSKKKEAPEDPKNLINIDKPIKELPASIAIPKEKPLTGEQQKMYDEVLKHFSNPDLKVYTSEKNKSEDDLKPLEEEEKAWLTRECFLRYLRATKWVLKDCIDRITMTLAWRREFGISHLGEEHGDKITADLVAVENESGKQVILGYENDARPILYLKPGRQNTKTSHRQVQHLVFMLERVIDFMPAGQDSLALLIDFKDYPDVPKVPGNSKIPPIGVGKEVLHILQTHYPERLGKALLTNIPWLAWTFLKLIHPFIDPLTREKLVFDEPFVKYVPKNELDSLYGGDLKFKYNHDVYWPALVETAREKRDHYFKRFQSFGGIVGLSEVDLRGTHEKLLYPVKSESSTV

SEQ ID NO: 163 - DNA, 46 bp, Artificial sequence
  primer
ggaattccagctgaccaccatgttcaagagatttagcaaaaagaag

SEQ ID NO: 164 - DNA, 45 bp, Artificial sequence
  primer
gatccccgggaattgccatgttacacggtactgctttccgatttt

SEQ ID NO: 165 - DNA, 588 bp, Saccharomyces cerevisiae
  CDS (1)..(588)
atgtccgggtcgttaaaatctctagacaagaaaatagctaaaagaaggcaggtgtataagcccgtgctagacaatccgttcacaaacgaagcacatatgtggccgcgcgtgcatgatcagccattgatttggcagctgctgcaatcctctatcataaataagttgattcacattcaatcgaaggagaactacccttgggagctgtatacagatttcaatgaaattgtgcagtatttgagcggcgctcacggaaacagcgacccagtatgtctatttgtgtgcaataaggaccctgatgtaccgcttgtgctcttgcagcaaatcccgctattatgctatatggcgcccatgacggttaaactggtgcagttgcccaagagtgccatggataccttcaagtcggtttctaaatatggaatgctgctgctgcggtgcgacgatagggtcgacaagaaattcgtatcgcagatccagaagaacgttgatctgcttcagtttccctggttaaatgctatcaagtatcggcccacatctgtcaagctgttgaaaactacagtgccaattgtctcgaagaagaggcaaaagtag

SEQ ID NO: 166 - protein, 195 aa, Saccharomyces cerevisiae
MSGSLKSLDKKIAKRRQVYKPVLDNPFTNEAHMWPRVHDQPLIWQLLQSSIINKLIHIQSKENYPWELYTDFNEIVQYLSGAHGNSDPVCLFVCNKDPDVPLVLLQQIPLLCYMAPMTVKLVQLPKSAMDTFKSVSKYGMLLLRCDDRVDKKFVSQIQKNVDLLQFPWLNAIKYRPTSVKLLKTTVPIVSKKRQK

SEQ ID NO: 167 - DNA, 43 bp, Artificial sequence
  primer
ggaattccagctgaccaccatgtccgggtcgttaaaatctcta

SEQ ID NO: 168 - DNA, 44 bp, Artificial sequence
  primer
gatccccgggaattgccatgctacttttgcctcttcttcgagac

SEQ ID NO: 169 - DNA, 1512 bp, Saccharomyces cerevisiae
  CDS (1)..(1512)
atgcacctagatctcatacacaagtccttcatcttagtgtggctcatatatatacgagccgcgttggctgaccaattcacatataaagcttgctattcagctagtgatatacgaaaattggggttgacttacaagggtgtttacgagtatcaatcagtttcctactgtcaaaatgaatgccctggtcaggctgtcgttgctcttttcaacggtacaggttgctactgtggtggttccgtagctcagttacagtctttgacgcaggtagattcgagcaaatgtgatgtttcgtgtgctggctggccctaccaaaattgtggtggttcttctgccatgaacgtttatatcaataacgctgcttctaccgcggactcaacttcatctactgctacctcaacatcgacaacatcttcatcaagcacaagtgttagttcaaaaacgtccacgaaattggacacgaaaacttcaactagttcttctgctacgcactcatcctcttcctcgtctacaacctccactaccacttcctcttcagagacaactacttcctcctcttcttcatcctcttcctcttctacgtctactacttctactacttctactacctctagtactacttctacttcttcttctccttccaccacttcctctagcacttctgcctcttccagttcagaaacgtcctctacgcaggcaacttcttcatccaccacatcgacctcatcctcaacttcgacagcaacggtcacttctaccccctcatcgacttcaataggtacttccacgcattacactacccgtgtggtgacgcagtccgtggtttctcaagctaaccaacaagcaagcacgatctttaccaccaggacctctgtttatgcaacagtatcgtctacgtcctcctctactagttctctcttaaacgggaaatcgagctcgtccaagagcaaaggcttgagtggtggcgccatcgcaggtgtcgtagtaggtgtggtttgtggtacagttgccttgttggctctggcgttattctttttcgtatggaaaaaacgtcgccaatcttctcagcatgtggacttggaagagacaaagcagtaccagccgtactcactgggtgatgctgacgctaaccctgttattccaccgtctgcttcgagcactaactggcacataccctctaggaataatacagcattgtccaagaatacagcgtctacttttgccacttatgatctgccgacaagggcgccgggcggcagagattctattattactggtgatgcacataatatcagcaaaagaagtcactttccctcggtagtgtacgaggagcctccttcgatctataacgggaaccaaaggttcagtgctacttcgctgcccgatatgatggaagaaagacaactacacattgtcaaccccgataatgtgagttcaaatattgggagtaatgtctcagatggtgatgatgattacgatgatgcaaaggattccaataatagttctttgcgctga

SEQ ID NO: 170 - protein, 503 aa, Saccharomyces cerevisiae
MHLDLIHKSFILVWLIYIRAALADQFTYKACYSASDIRKLGLTYKGVYEYQSVSYCQNECPGQAVVALFNGTGCYCGGSVAQLQSLTQVDSSKCDVSCAGWPYQNCGGSSAMNVYINNAASTADSTSSTATSTSTTSSSSTSVSSKTSTKLDTKTSTSSSATHSSSSSSTTSTTTSSSETTTSSSSSSSSSSTSTTSTTSTTSSTTSTSSSPSTTSSSTSASSSSETSSTQATSSSTTSTSSSTSTATVTSTPSSTSIGTSTHYTTRVVTQSVVSQANQQASTIFTTRTSVYATVSSTSSSTSSLLNGKSSSSKSKGLSGGAIAGVVVGVVCGTVALLALALFFFVWKKRRQSSQHVDLEETKQYQPYSLGDADANPVIPPSASSTNWHIPSRNNTALSKNTASTFATYDLPTRAPGGRDSIITGDAHNISKRSHFPSVVYEEPPSIYNGNQRFSATSLPDMMEERQLHIVNPDNVSSNIGSNVSDGDDDYDDAKDSNNSSLR

SEQ ID NO: 171 - DNA, 44 bp, Artificial sequence
  primer
ggaattccagctgaccaccatgcacctagatctcatacacaagt

SEQ ID NO: 172 - DNA, 45 bp, Artificial sequence
  primer
gatccccgggaattgccatgtcagcgcaaagaactattattggaa

SEQ ID NO: 173 - DNA, 858 bp, Saccharomyces cerevisiae
  CDS (1)..(858)
atggatgctgatgaattggaattgaaaggtcatttgaaaaaattgaaaaaagaagaattgcttagaaggaaacagttaaaagagagtaatcttcagaaaagagagcttgaatataataatgcctcaaaaaatacttcaatatatatttctggtcttcccacagacaaaacaacgaaagaaggactcactgagcagttttgcaagtatggaatgataagaaccaatcgagatggggaacccctttgcaagctatatgtgaatgataaaggcgctttcaaaggggatgccttgatcacttattccaaggaagaaagtgttacattagcaatcgaaatgatgaacgagtcgatcttcctgggaaaacagatcagggtcgaaagagcccaatttcaaaacaaggaaggtgacaatatgcacgggaaagaaaatgatttaaaggagttcaacggacctgagcctccaataaagaggctaaaaaaagcgaagtctgaaggggagggggaagtaatagattacaatgacgatgaaagcctagcaaaagctgatcgaacggtgatatttgccaacgtattcaatatttacaaatcatacacaaatgatgatataaatgatattcaggaagatcttttggaaggctgtgaagagataggtcaagtagacagtatatctgtatctcccaataagggggaagcgacggtcgtctttaagaacaataaagttgcattgcaatgttgcaaaatcatgaccggacgttattttgatgggcaaaagttgcttgctttcatttctggagatgagaacacttcaagcacaagtgacaagaatgaggacagcgaagtggaagatgaccttatatag

SEQ ID NO: 174 - protein, 285 aa, Saccharomyces cerevisiae
MDADELELKGHLKKLKKEELLRRKQLKESNLQKRELEYNNASKNTSIYISGLPTDKTTKEGLTEQFCKYGMIRTNRDGEPLCKLYVNDKGAFKGDALITYSKEESVTLAIEMMNESIFLGKQIRVERAQFQNKEGDNMHGKENDLKEFNGPEPPIKRLKKAKSEGEGEVIDYNDDESLAKADRTVIFANVFNIYKSYTNDDINDIQEDLLEGCEEIGQVDSISVSPNKGEATVVFKNNKVALQCCKIMTGRYFDGQKLLAFISGDENTSSTSDKNEDSEVEDDLI

SEQ ID NO: 175 - DNA, 44 bp, Artificial sequence
  primer
ggaattccagctgaccaccatggatgctgatgaattggaattga

SEQ ID NO: 176 - DNA, 45 bp, Artificial sequence
  primer
gatccccgggaattgccatgctatataaggtcatcttccacttcg

SEQ ID NO: 177 - DNA, 1290 bp, Saccharomyces cerevisiae
  CDS (1)..(1290)
atgtctgcattgagaaacatcaagttcaatgaagaagaagatggtgaactaccctgcctcgtaacaggtgaagaaaataatctacaagaaattttggaaaatgtctcgtatgatggtggaaatattgttagcgatgcaaaagttgaaagggtaaacaagcaagtggagaacacttctgcaggcgcaacagatgtgcacgagaaaaagcgtattcctgtgagcattattaccggctatctaggatcaggtaaatcgacgttgctggaaaaaattgcattaaaaggtgcagataaaaaaattgccgtaattttaaatgaatttggagattctagtgaaatcgaaaaggctatgaccattaaaaatggatcgaacagctaccaagaatggttggatttgggtaacgggtgtctgtgttgttcgttgaaaaatataggtgttaaagccatcgaagatatggtggagcgttcacctggtaaaatcgattatatccttttagagacctccggtattgcagatcccgcccccattgcgaaaatgttctggcaggacgaaggattgaatagcagcgtttacattgacgggatcatcacggttttggattgtgagcatatactaaaatgcttagatgatatttccatcgatgcccattggcatggtgacaaagttggtttggaggggaatctgactattgcacacttccaactagccatggctgatcgaattataatgaacaaatacgatactatcgaacattcaccagaaatggtcaaacaattaaaagaaagagtacgggaaataaattctatcgcaccgatgttcttcaccaagtatagtgatacgccgattcaaaatttactagatattcatgcatacgacagtgtacggatatctgacatcttagatagtggtagcggaaacggtaccattcatgatgatcgaatgggcacaataatgcttactttcagaccattaaaaaacgaggaagaatataataataagtttattaagcaatttttgcaacctttattgtggaagaattttggagccatgacagtgctgggagggcgtcgccgagatgacggccgtgattgggaagtacaaagaactaaaggtctgatacttattgaaggagagaaccccattgctcgtgtaatccaaggcgtccgcgacacctacgatgtctttccaggcaaatatgacggatccaataaagagtgtaaaattgtgctgattgggaagtacctagaaaaggaatccatagaggaactgttacgtaaaaccctggaatga

SEQ ID NO: 178 - protein, 429 aa, Saccharomyces cerevisiae
MSALRNIKFNEEEDGELPCLVTGEENNLQEILENVSYDGGNIVSDAKVERVNKQVENTSAGATDVHEKKRIPVSIITGYLGSGKSTLLEKIALKGADKKIAVILNEFGDSSEIEKAMTIKNGSNSYQEWLDLGNGCLCCSLKNIGVKAIEDMVERSPGKIDYILLETSGIADPAPIAKMFWQDEGLNSSVYIDGIITVLDCEHILKCLDDISIDAHWHGDKVGLEGNLTIAHFQLAMADRIIMNKYDTIEHSPEMVKQLKERVREINSIAPMFFTKYSDTPIQNLLDIHAYDSVRISDILDSGSGNGTIHDDRMGTIMLTFRPLKNEEEYNNKFIKQFLQPLLWKNFGAMTVLGGRRRDDGRDWEVQRTKGLILIEGENPIARVIQGVRDTYDVFPGKYDGSNKECKIVLIGKYLEKESIEELLRKTLE

SEQ ID NO: 179 - DNA, 44 bp, Artificial sequence
  primer
ggaattccagctgaccaccatgtctgcattgagaaacatcaagt

SEQ ID NO: 180 - DNA, 46 bp, Artificial sequence
  primer
gatccccgggaattgccatgtcatattttaatggtttttggcttgc

SEQ ID NO: 181 - DNA, 912 bp, Saccharomyces cerevisiae
  CDS (1)..(912)
atgactgttactgacacttttaaactgtttattttaaggcatggtcaaagtgaattaaactcagaaaacatattctgcggatggattgatgctcaattaacggaaaaagggaagtctcaggcccgccactctgcaaaattgatcaagcagttttgcgattctaacaatatctctttgcctcagattggctatacttcaaggttgattcgaactcagcagaccatggacgttattctcgaagagttgggactaaaacacaccaattatgtaattactacgaatacaaacattaaggaggagctgcaggacacaagatttgaaggaagtatgcctgtgttgcaaacctggaggttaaatgagcgtcattacggcgcatggcaaggacaaagaaagccagatatcttgaaagaatacggtaaggaaaaatacatgtatatcagaagagattacaacggaaaaccccctaaagtcaacctaaacctggaaatggtccaagaggaaaatgatcaggggtcctccacaggctatgattttaaggagcccaatagacacttaaaatacggccccgaagagaaggctaatgagcgtctgccagaaagtgagtctctttgtgaagtggtcgtcagattgaaaccatttttaaataatgttgttctgtctaccgccaacaaaatcagtcaagaatcgtgtgttatagttgggcatggcagctctgtaagatctctgctgaaagtattggaaggtatctcagatgaagacatcaaagatgtcgatattcccaacggcattccgctagttatagagttggatagagacaattactcttttgtgaggaaattttacttggatccagaatcagctaaagttaatgctcaaatggttcgtgatgagggtttcgaaaagaatccatga

SEQ ID NO: 182 - protein, 303 aa, Saccharomyces cerevisiae
MTVTDTFKLFILRHGQSELNSENIFCGWIDAQLTEKGKSQARHSAKLIKQFCDSNNISLPQIGYTSRLIRTQQTMDVILEELGLKHTNYVITTNTNIKEELQDTRFEGSMPVLQTWRLNERHYGAWQGQRKPDILKEYGKEKYMYIRRDYNGKPPKVNLNLEMVQEENDQGSSTGYDFKEPNRHLKYGPEEKANERLPESESLCEVVVRLKPFLNNVVLSTANKISQESCVIVGHGSSVRSLLKVLEGISDEDIKDVDIPNGIPLVIELDRDNYSFVRKFYLDPESAKVNAQMVRDEGFEKNP

SEQ ID NO: 183 - DNA, 45 bp, Artificial sequence
  primer
ggaattccagctgaccaccatgactgttactgacacttttaaact

SEQ ID NO: 184 - DNA, 45 bp, Artificial sequence
  primer
gatccccgggaattgccatgtcatggattcttttcgaaaccctca

SEQ ID NO: 185 - DNA, 351 bp, Saccharomyces cerevisiae
  CDS (1)..(351)
atgcaagcacgccggcaaacccttcctcaatttataaaatgtaaacaaacgaaatgtaaaatcaaactagcaacaataaactcggcaaaagctctgtttttagaaatgcctggaaaactattacacaattgtaaccgcaaactcatcaataggacgaattgtcccacacaaataatgaatcccgctaaaaacgcattgaatggaaaattatcacggatcaagataatgaatgtacactggatcacccctaataataccaaaaagaagcagaatgtatcaattagtttcagtttaggatatttttcaatttgggcaaaatatgccctcttagaagtcttgaaagtttcttga

SEQ ID NO: 186 - protein, 116 aa, Saccharomyces cerevisiae
MQARRQTLPQFIKCKQTKCKIKLATINSAKALFLEMPGKLLHNCNRKLINRTNCPTQIMNPAKNALNGKLSRIKIMNVHWITPNNTKKKQNVSISFSLGYFSIWAKYALLEVLKVS

SEQ ID NO: 187 - DNA, 40 bp, Artificial sequence
  primer
ggaattccagctgaccaccatgcaagcacgccggcaaacc

SEQ ID NO: 188 - DNA, 46 bp, Artificial sequence
  primer
gatccccgggaattgccatgtcaagaaactttcaagacttctaaga

SEQ ID NO: 189 - DNA, 1764 bp, Saccharomyces cerevisiae
  CDS (1)..(1764)
atggcgaaccgtcttctcatatacggccttattttgtgggtaagtataatcggatcttttgcattagataggaacaaaactgctcaaaatgcgaagattggtctacatgataccactgtgatcacgactggaagtacaacgaacgtgcagaaagaacattcctcaccactatccaccggttctttaagaacccatgattttagacaggcctctaaagttgacatacggcaggctgacatacgggaaaacggtgagaggaaagagcaagatgcactaacacagcctgcaacaccaaggaatccgggcgattcgagtaattcatttttatcgttcgacgaatggaagaaggtcaagtcgaaggagcactcatcaggccctgaacgtcatcttagtcgagtgagggagccagtcgatccctcttgctataaagagaaagaatgcataggagaagagttggaaatcgatttggggtttttgacaaacaaaaacgagtggagtgaaagagaagaaaatcaaaaaggattcaatgaggaaaaggacatagagaaagtttacaaaaaaaaattcaactatgcatccttggattgcgctgcaacaattgtcaaaagcaatccagaagcgattggagcgacttctacgttaattgagagcaaagacaagtatttactgaatccctgttcagctccgcagcaattcattgttatagagctttgtgaagatatcctggtggaggaaattgaaattgctaattacgaattcttttcctcgaccttcaagagatttagggtgtcagtttctgatagaataccgatggttaaaaatgaatggacaatattaggagaattcgaggcaagaaattcaagagaactacaaaagtttcaaatacataatccccaaatctgggcaagttatttgaaaatcgaaattctatcccattatgaggacgaattttattgtcccatatccttaatcaaagtatatggtaaatcaatgatggatgagtttaagatcgatcaactaaaggctcaagaggataaagaacaatccataggaactaacaatataaacaatttgaatgaacaaaatatccaagacagatgtaacaatatagaaacgcgtttagagactccaaacacaagcaatctctcagacttagctggtgcattatcatgtacttcaaagctcatccctttgaagttcgatgaatttttcaaggtgcttaatgcatccttttgtccttccaagcaaatgatatcttcttcttcttcttcggctgttcctgtaattccagaagaatccatttttaagaacatcatgaaaaggctgtcacaactggagacaaattctagtttgacagtttcttacattgaggaacagagcaaactgctatctaaatcgtttgaacaacttgaaatggcgcacgaagcaaagttcagtcatcttgtcacgatattcaacgaaacaatgatgagtaatctagatctgctgaataactttgccaatcaattgaaagatcaatctttacgtatattagaagaacagaaactggagaatgacaaatttactaaccgtcatttattgcatttggaaagattggaaaaagaagtcagttttcaaagaagaattgtttatgcgtcatttttcgccttcgtagggttgatatcctatctattaataacgagagagctttactttgaagatttcgaagagagcaaaaatggcgctattgaaaaggcagacattgttcaacaagcaatcagatga

SEQ ID NO: 190 - protein, 587 aa, Saccharomyces cerevisiae
MANRLLIYGLILWVSIIGSFALDRNKTAQNAKIGLHDTTVITTGSTTNVQKEHSSPLSTGSLRTHDFRQASKVDIRQADIRENGERKEQDALTQPATPRNPGDSSNSFLSFDEWKKVKSKEHSSGPERHLSRVREPVDPSCYKEKECIGEELEIDLGFLTNKNEWSEREENQKGFNEEKDIEKVYKKKFNYASLDCAATIVKSNPEAIGATSTLIESKDKYLLNPCSAPQQFIVIELCEDILVEEIEIANYEFFSSTFKRFRVSVSDRIPMVKNEWTILGEFEARNSRELQKFQIHNPQIWASYLKIEILSHYEDEFYCPISLIKVYGKSMMDEFKIDQLKAQEDKEQSIGTNNINNLNEQNIQDRCNNIETRLETPNTSNLSDLAGALSCTSKLIPLKFDEFFKVLNASFCPSKQMISSSSSSAVPVIPEESIFKNIMKRLSQLETNSSLTVSYIEEQSKLLSKSFEQLEMAHEAKFSHLVTIFNETMMSNLDLLNNFANQLKDQSLRILEEQKLENDKFTNRHLLHLERLEKEVSFQRRIVYASFFAFVGLISYLLITRELYFEDFEESKNGAIEKADIVQQAIR

SEQ ID NO: 191 - DNA, 43 bp, Artificial sequence
  primer
ggaattccagctgaccaccatggcgaaccgtcttctcatatac

SEQ ID NO: 192 - DNA, 45 bp, Artificial sequence
  primer
gatccccgggaattgccatgtcatctgattgcttgttgaacaatg

SEQ ID NO: 193 - DNA, 306 bp, Saccharomyces cerevisiae
  CDS (1)..(306)
atgatatataactggggatgtataattataatgaaaacaaaaatggaatataaaccatactccgatgatagaaacattatatcgccttttcttttcgatgtagtatttctttttacaaaaaaatcatttttgaaggaaaatataacgttaatctacatggattcaaactctgtatcgatatatctaccattccttagcaacgtcttgcataacatgggcattatttccacttgcaagggttccaaaggaaacttttcaccatccactgaaaataaacctgactccacttttggtataatcttataa

SEQ ID NO: 194 - protein, 101 aa, Saccharomyces cerevisiae
MIYNWGCIIIMKTKMEYKPYSDDRNIISPFLFDVVFLFTKKSFLKENITLIYMDSNSVSIYLPFLSNVLHNMGIISTCKGSKGNFSPSTENKPDSTFGIIL

SEQ ID NO: 195 - DNA, 46 bp, Artificial sequence
  primer
ggaattccagctgaccaccatgatatataactggggatgtataatt

SEQ ID NO: 196 - DNA, 47 bp, Artificial sequence
  primer
gatccccgggaattgccatgttataagattataccaaaagtggagtc

SEQ ID NO: 197 - DNA, 1272 bp, Saccharomyces cerevisiae
  CDS (1)..(1272)
atggattctcgagttgcactggtacgaaaatacatagcaccatcggtgataaaaagcgattctattcaattgcacggtttagtgaaggcaccactatttaaagcgttgaatagccgttacaaattaggttcactacagatagtacaggatgtcgattggaatgcgaagacaacaccatccgattctccagagcctctggccgctactctaaactctaatcgatccctaccaatgactaagttccccaagcaggagatcttggaacaggtaaaattggatactaaggttggcaaatggaggaaattcatgacaggttggtttagaattggattgtatcttttaaaaagctataaaacaggaattcagaacacgttaaaagtattctgggatactcgaaacgaagagcagaaattcagcataaaaaacggtgcattggctaacttagtacgggaaatagaaatgcatgaaatcaatacaagactatcgtcttcatcattgcctacaagttcttcagcaaaagccccattaaggccactttcaatcaataggaaaacactggtggaactgatcagacgagatcaaatctggaaattacctgtatttttcaccttagtattcatatttgaggaggtaagtgtattgatctttaccttttttccacgtgtctgtccgtacaattgtttaactcctggtggatacaagaagctttccaactcatatatcaagggaacaacaagcacacaaggtaactacggtctgggtcccttagagtttactaagcaaggtacaattaagtatgagccaccatatgcagttcctattgagaatttgtataattttctgacaagctttcctcaaagtatgatatcaaactggaaactgtatatttataaaaagttaaaattacagaagctactttgcaatgagatagaaaaaatttaccagtatctgtttatcgatgactggttgctgttgcagagtatactcaacactgatgttgagaaaactaaaatcgcgctaagtgatagagaattggttaactgtatacttgaaagaaaactttatcacatgggcgatgacttgaatgagatggttaatgacacgttagggaaagaaatcttactgaaaagattgtttctttattggacattaagatataatgacactatatccttaaacggaaagcatacattcagtgagaaatggggtgtcaacaatatatcattgttaaaatataattcagaattggtagctacgaaagatattcaatag

SEQ ID NO: 198 - protein, 423 aa, Saccharomyces cerevisiae
MDSRVALVRKYIAPSVIKSDSIQLHGLVKAPLFKALNSRYKLGSLQIVQDVDWNAKTTPSDSPEPLAATLNSNRSLPMTKFPKQEILEQVKLDTKVGKWRKFMTGWFRIGLYLLKSYKTGIQNTLKVFWDTRNEEQKFSIKNGALANLVREIEMHEINTRLSSSSLPTSSSAKAPLRPLSINRKTLVELIRRDQIWKLPVFFTLVFIFEEVSVLIFTFFPRVCPYNCLTPGGYKKLSNSYIKGTTSTQGNYGLGPLEFTKQGTIKYEPPYAVPIENLYNFLTSFPQSMISNWKLYIYKKLKLQKLLCNEIEKIYQYLFIDDWLLLQSILNTDVEKTKIALSDRELVNCILERKLYHMGDDLNEMVNDTLGKEILLKRLFLYWTLRYNDTISLNGKHTFSEKWGVNNISLLKYNSELVATKDIQ

SEQ ID NO: 199 - DNA, 43 bp, Artificial sequence
  primer
ggaattccagctgaccaccatggattctcgagttgcactggta

SEQ ID NO: 200 - DNA, 45 bp, Artificial sequence
  primer
gatccccgggaattgccatgctattgaatatctttcgtagctacc

SEQ ID NO: 201 - DNA, 456 bp, Saccharomyces cerevisiae
  CDS (1)..(456)
atgtctgactgggatacaaatactattattggtagcagagcaagagctggtggttctggcccaagggccaacgttgccagatctcaaggccaaattaatgctgcaagaagacaggggttggttgtttccgttgacaagaagtacggatcaaccaatacgaggggtgacaacgagggtcagaggttgaccaaggtcgaccgtgagacagatattgtcaaacccaagaaattggatccaaatgtcggtagggccatctcgcgtgccagaacagacaagaaaatgtcgcagaaggatttggcaaccaaaattaacgaaaagccaaccgtggtaaacgattatgaagccgctagagctattccaaaccaacaagttttgtctaagttggaaagagccttaggcgttaaattgagaggtaacaacatcggttcgcctttgggagctccaaagaagaaatga

SEQ ID NO: 202 - protein, 151 aa, Saccharomyces cerevisiae
MSDWDTNTIIGSRARAGGSGPRANVARSQGQINAARRQGLVVSVDKKYGSTNTRGDNEGQRLTKVDRETDIVKPKKLDPNVGRAISRARTDKKMSQKDLATKINEKPTVVNDYEAARAIPNQQVLSKLERALGVKLRGNNIGSPLGAPKKK

SEQ ID NO: 203 - DNA, 44 bp, Artificial sequence
  primer
ggaattccagctgaccaccatgattacgcagaattctataccag

SEQ ID NO: 204 - DNA, 47 bp, Artificial sequence
  primer
gatccccgggaattgccatgtcagtttcttccaaatatatacaaatg

SEQ ID NO: 205 - DNA, 1704 bp, Saccharomyces cerevisiae
  CDS (1)..(1704)
atgactggcgacggtagtgcacatatttctaaaaacaatcaaaatcaacacaaagatcgcttcaagtttattgtgaatgataaaagtattctaggacctcaatggttaagcctttaccaaacggatgggaaagtaacattcgcaaagtcccacttcgagcaagcaatgatgaacgttattagagaaccaaatattaactctactgtcatattaagagcggatattttgaaagagatcaatcatgctgcagaagctgggtctgagccaaaatttgacgagtccgtattaaaaaagtttgagatcgataatggtaatgaaagcggtgaagaagatgtcaagaagataaatattgaagatttaaacataaggtcgtgtgaaacatctgagagtttaaaattgtcacccgttcatgaatttgtaagaaggatcattcctaggaatttttacaaagatgctatcataaaccaaacatgtttaatcctaaatagcaaagaccctaattttcaggagacctcattgattgtatatacgccgcacattaactctgagaaagactgtccgttttatattccaagaacgcaaagtgtaggcattttgttacaccagtcagttctttctgtacactacattcccttccccgaggataaaactgcctttacagatgaatctgagcgtgttgtaagaaccgcttataggttattacaaactgctaacaaacactcaaagggtgtgatgcagggttatgaaaagagggtcaatcacgatcaagtggtaaataaagtcaattttcagaacacatacattgttttgaagaaaaaatactccaagttcctggtggagaattgggcagagtctacagacccaaaaaaacatgtttttgaagacatagccattgccgctttcctgattgaattatggattaaagtgtacggtccagacttccgttcaaaaatgcaatttagagatttgggatgcggcaatggtgctctttgttatattttactgagtgaaagtattaaaggtctcggcatagatgcaaggaagcgcaaatcgtggtctatctacccgcctgaagtgcaatcatcgttaaaggagcaagttataataccttctatccttttaagaccccatcctgctttgaaaagacaagtacctcatttggaacacaatgggagatttttcccagtcaaggtgacgcacgaagtgattgcccccgcaaccgtcgtgtattcaagtgaggacttactaaaatctccgcaggtcaatacagcagagttcccaccagatacttttattataggtaaccactcagatgagttgacttgctggatcccattactaggtcatccttatatggttataccttgttgctctcataatttttctggccagagagttcgttttaacgtaaggaaacgttcgcctaggtcaaatgaaatcaaaaaccagaataacagtaagagcacctactctggtttggttgatcacgttgaatatatttcatctcgtgtaggctggaaagtagagaaagagatgttaaggataccaagcacaagaaatgcagccatcataggtgtagaaaatgcaaccttaaagcattttccaacgcaagcagtgtacgatatgatttgggaagacggtggagctgaagggtggattcagaacacaatgtccttattgaaaagaaacccaagaaaccattaa

SEQ ID NO: 206 - protein, 567 aa, Saccharomyces cerevisiae
MTGDGSAHISKNNQNQHKDRFKFIVNDKSILGPQWLSLYQTDGKVTFAKSHFEQAMMNVIREPNINSTVILRADILKEINHAAEAGSEPKFDESVLKKFEIDNGNESGEEDVKKINIEDLNIRSCETSESLKLSPVHEFVRRIIPRNFYKDAIINQTCLILNSKDPNFQETSLIVYTPHINSEKDCPFYIPRTQSVGILLHQSVLSVHYIPFPEDKTAFTDESERVVRTAYRLLQTANKHSKGVMQGYEKRVNHDQVVNKVNFQNTYIVLKKKYSKFLVENWAESTDPKKHVFEDIAIAAFLIELWIKVYGPDFRSKMQFRDLGCGNGALCYILLSESIKGLGIDARKRKSWSIYPPEVQSSLKEQVIIPSILLRPHPALKRQVPHLEHNGRFFPVKVTHEVIAPATVVYSSEDLLKSPQVNTAEFPPDTFIIGNHSDELTCWIPLLGHPYMVIPCCSHNFSGQRVRFNVRKRSPRSNEIKNQNNSKSTYSGLVDHVEYISSRVGWKVEKEMLRIPSTRNAAIIGVENATLKHFPTQAVYDMIWEDGGAEGWIQNTMSLLKRNPRNH

SEQ ID NO: 207 - DNA, 22 bp, Artificial sequence
  primer
atgactggcgacggtagtgcac

SEQ ID NO: 208 - DNA, 28 bp, Artificial sequence
  primer
ttaatacgcctgtataaataataaaatg

SEQ ID NO: 209 - DNA, 1407 bp, Saccharomyces cerevisiae
  CDS (1)..(1407)
atgaattttgttacctgccatgttcagatgaggcttcttctccaaaggagactagtgcgtttacgagaatcagagctgtttagaccccagacatcattgtcaactttcaaaagacatgcttcgcaaaagacacgccctatacaaaaatgctcgagaaaatacgcacgtatacttctgttgtctgttttggtaccttacacaggatatgcgttttatgtatcattggctacagtgaagcaaattgatttaagaaacgaaatgtgtcaaagattagaggagaataataacgaggtcacttataagggatccttgctaaaatatagccctttggaagttttaggcagatttgagaacccgttcgaagaatacaggattcagaccgtttttgaattctttgcaaatagagtgttcgaattatttgaaagaaataggggaggtattccacgtgatgtacaccaaatgaataagttaatgcctgtacacaagccaacatgggggcctaacttagtggacgtcgaccccgcagaggaaacggcattgccgctagaatgcaaagtgttagacgaattgcacataccgactgcagtagaagaaaatgaaggatcaaagtgcccagtctataacacatggctgggccagtcctgtaactacacggtttataatggattgaggatacttactgatcctctgttcagtgactttcttatccacaagaccctgggtcctaaaagaattactcaaatgccatctcaaattacagaggtgcccaaaccagatatcatccttgtatcccataatcaccccgatcacctggatttagaaagcttggaatactggagtggcaaagactctcccttatggatagtacctaaaggaatgaaatcttatatgacaagtaacggctgtgataatgtcctagaattatcttggtgggaaactttgcaagtaaagaaaaacaatgagatataccacatatcggctactcctgccatgcattggtctgggagatcgctcttagatacgaacaagtctctatggtgctcctttttattaacacaccatggtaatcccatactttttcatgctggtgacactggatatgtgaaagatttattcgttagaattaaagaacgctttggcaaaggttgtaaattagcgctgcttccatgtggtcagtattgccctgagtggcaccaaaaaccacgacatattaatcctcaagaggttctcaagattatgaaagatctagaagctcgaaatgtattaggcgttcattgggggacctttgtattaagcggagaatatttcttagagccaaaggaaaaattagaaatgttggccgagtggggtgggtttaaagaccgctgctactgtccagaattgggcaagacagaatgcttcgactaa

SEQ ID NO: 210 - protein, 468 aa, Saccharomyces cerevisiae
MNFVTCHVQMRLLLQRRLVRLRESELFRPQTSLSTFKRHASQKTRPIQKCSRKYARILLLSVLVPYTGYAFYVSLATVKQIDLRNEMCQRLEENNNEVTYKGSLLKYSPLEVLGRFENPFEEYRIQTVFEFFANRVFELFERNRGGIPRDVHQMNKLMPVHKPTWGPNLVDVDPAEETALPLECKVLDELHIPTAVEENEGSKCPVYNTWLGQSCNYTVYNGLRILTDPLFSDFLIHKTLGPKRITQMPSQITEVPKPDIILVSHNHPDHLDLESLEYWSGKDSPLWIVPKGMKSYMTSNGCDNVLELSWWETLQVKKNNEIYHISATPAMHWSGRSLLDTNKSLWCSFLLTHHGNPILFHAGDTGYVKDLFVRIKERFGKGCKLALLPCGQYCPEWHQKPRHINPQEVLKIMKDLEARNVLGVHWGTFVLSGEYFLEPKEKLEMLAEWGGFKDRCYCPELGKTECFD

SEQ ID NO: 211 - DNA, 43 bp, Artificial sequence
  primer
ggaattccagctgaccaccatggaggaacaacgtgaaatactg

SEQ ID NO: 212 - DNA, 44 bp, Artificial sequence
  primer
gatccccgggaattgccatgtcacaactcgccgaattcatcgta

SEQ ID NO: 213 - DNA, 369 bp, Saccharomyces cerevisiae
  CDS (1)..(369)
atggcgtctacggtagccggattatcaatgtcagcggaatcgctccggttaccgctattaataggagtaagtagcggtatgttatcagtgtctgatgcagaggtattaccatcgttcctcttcaaatctggtttctcagtattacaaagtgctgcattggatacagatgacgacctcgcacgaggcttatcattgctagacctgttaccactcgtgctattgtctccgtttttcgaagaggacgtagatgaagaggaggctggcgacgtagaaggcctcgatggcttcgtatttgtcttccgtctactcttacctttatacaaccaatctacgggcacatcgaactcggtgttagttatcataacctag

SEQ ID NO: 214 - protein, 122 aa, Saccharomyces cerevisiae
MASTVAGLSMSAESLRLPLLIGVSSGMLSVSDAEVLPSFLFKSGFSVLQSAALDTDDDLARGLSLLDLLPLVLLSPFFEEDVDEEEAGDVEGLDGFVFVFRLLLPLYNQSTGTSNSVLVIIT

SEQ ID NO: 215 - DNA, 41 bp, Artificial sequence
  primer
ggaattccagctgaccaccatggcgtctacggtagccggat

SEQ ID NO: 216 - DNA, 45 bp, Artificial sequence
  primer
gatccccgggaattgccatgctaggttatgataactaacaccgag

SEQ ID NO: 217 - DNA, 546 bp, Saccharomyces cerevisiae
  CDS (1)..(546)
atgagacagctaacagaagaagagaccaaggttgttttcgaaaaactcgccggctatattggtagaaatatttcttttttagtggataataaagaacttcctcatgtcttcagattacaaaaggatagagtatattacgtacccgatcatgttgcaaaattggctactagtgtagcaagacctaacttgatgtctctgggtatttgtttaggtaaattcacgaaaactggaaaattcaggttacatattacttctttgacagtattggctaagcatgccaaatataagatatggattaaacctaatggggagatgccattcttatacggtaatcatgtgttaaaggcacatgtgggtaaaatgtctgatgatataccagaacacgccggtgttattgtgtttgcaatgaatgatgtgccattagggttcggtgtcagtgcgaaaagtacttctgagtcaagaaacatgcaacccactggtatagttgctttcagacaagcagatattggtgagtatttgagagatgaagacaccttgtttacttag

SEQ ID NO: 218 - protein, 181 aa, Saccharomyces cerevisiae
MRQLTEEETKVVFEKLAGYIGRNISFLVDNKELPHVFRLQKDRVYYVPDHVAKLATSVARPNLMSLGICLGKFTKTGKFRLHITSLTVLAKHAKYKIWIKPNGEMPFLYGNHVLKAHVGKMSDDIPEHAGVIVFAMNDVPLGFGVSAKSTSESRNMQPTGIVAFRQADIGEYLRDEDTLFT

SEQ ID NO: 219 - DNA, 44 bp, Artificial sequence
  primer
ggaattccagctgaccaccatgagacagctaacagaagaagaga

SEQ ID NO: 220 - DNA, 45 bp, Artificial sequence
  primer
gatccccgggaattgccatgctaagtaaacaaggtgtcttcatct

SEQ ID NO: 221 - DNA, 612 bp, Oryza sativa
  CDS (1)..(612)
atggcggcggaggcggcagcggcgctggaggggagcgagcccgtggacctggccaagcacccctccggcatcatccccacgctccaaaacatcgtatcgacggtcaatttggattgcaaattagacctcaaagctatagctttgcaagctcgcaatgcagaatataatccaaagcgttttgctgcggttatcatgagaataagagaaccaaaaactacagctctgatatttgcatcgggtaaaatggtctgtactggggcaaagagtgaacaacaatccaagcttgcagcaagaaagtacgctcgtattatccagaagcttggctttcctgctaaattcaaggatttcaagattcagaacattgttggctcttgtgatgttaaatttccaatcaggctggagggacttgcatattctcatggtgctttctcaagttatgagccagaactctttcctggtctgatatatcggatgaagcaaccaaagattgttcttctgatttttgtttcaggcaagattgttttgaccggagcaaaggtgagggatgagacgtataccgcctttgagaacatataccctgtgctaacggagttcagaaaagtccagcagtga

SEQ ID NO: 222 - protein, 203 aa, Oryza sativa
MAAEAAAALEGSEPVDLAKHPSGIIPTLQNIVSTVNLDCKLDLKAIALQARNAEYNPKRFAAVIMRIREPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKVQQ

SEQ ID NO: 223 - DNA, 489 bp, Zea mays
  CDS (1)..(489)
atgggagttacggtctcaatggtggtgccttcgaccatggagccgggcttgggacccaatggctgcctcttggtgctgataccctctccgcgctttttggcatccgccttcagctggtcacttttcgccttcctcaggcggtactcatgtgtgcaccgggacggctgcacatgctccgcgcggacatgcatacgcttctttatgatgcgcccattgacatgcttgttgacctcgaccccaatggcgatgcttggggacgttccaaactccaccggtccgcccgtggtaccatttgtgcggcatccccttgtggccggcaccgttcactttgacactatcgtaatcaccgatcttgtatgtgtggaggtaggtggtgagcgggatgtagcccttcttacgcaaggggcgcgcgaagagctcgcgcgtccgtcgagcgcaggccgtggccagccggcatcctgtctccacctgcttgtacgctcggcgtga

SEQ ID NO: 224 - protein, 162 aa, Zea mays
MGVTVSMVVPSTMEPGLGPNGCLLVLIPSPRFLASAFSWSLFAFLRRYSCVHRDGCTCSARTCIRFFMMRPLTCLLTSTPMAMLGDVPNSTGPPVVPFVRHPLVAGTVHFDTIVITDLVCVEVGGERDVALLTQGAREELARPSSAGRGQPASCLHLLVRSA

SEQ ID NO: 225 - DNA, 837 bp, Zea mays
  CDS (1)..(837)
atggtcgacccacgcgtccgcccagaagtcacgcaccaaacaccaccaccaaagaaggcgagaacgtactccgtccctcccctcccctcccctccccttcccctcgaggctccaggaccgtctcctcgcctgctcatccgccgctgcttcccttctctgggctcggagaaccggagagaagcgcgcgcggccatggcgtccagcgcctctcggttcatcaagtgcgtcacggtcggcgacggtgccgtgggcaagacatgtatgctcatctgctacaccagcaacaagttccccactgactacatacctacggtgttcgacaatttcagtgcaaatgtagttgtggatggcaccactgtgaatttgggcctttgggataccgctgggcaggaagattacaaccgcctgaggcctctaagctaccgaggtgcagatgttttcgtgcttgcattctcacttgtgagccgagctagctatgagaatatcatgaagaagtggataccagagcttcaacattatgcacctggggtgcccgttgttttggcaggcacaaaattggatcttcgtgaagacaagcactacttgatggaccatcctggattggtgcctgttaccactgcacagggggaggaacttcgtagacaaattggtgctatgtattacattgaatgcagctcaaagacacagcagaatgtcaaagctgtgttcgatgctgccatcaaggtagtaatccagcctccaactaaaataagagaaaagaagaagaaaaaatcacgcaaaggatgttctatgatgaacatcttcggtggaagaaaaatgctatgcttcaagtcctga

SEQ ID NO: 226 - protein, 278 aa, Zea mays
MVDPRVRPEVTHQTPPPKKARTYSVPPLPSPPLPLEAPGPSPRLLIRRCFPSLGSENRREARAAMASSASRFIKCVTVGDGAVGKTCMLICYTSNKFPTDYIPTVFDNFSANVVVDGTTVNLGLWDTAGQEDYNRLRPLSYRGADVFVLAFSLVSRASYENIMKKWIPELQHYAPGVPVVLAGTKLDLREDKHYLMDHPGLVPVTTAQGEELRRQIGAMYYIECSSKTQQNVKAVFDAAIKVVIQPPTKIREKKKKKSRKGCSMMNIFGGRKMLCFKS

SEQ ID NO: 227 - DNA, 948 bp, Zea mays
  CDS (1)..(948)
atgcttgctcacctccataaaccaacccaaaagccccccaatttcacgctagataaaccataccccaaccctctgacgatgccttctacgccgacgctggtccctccgtgcgacgcggtggagccactgctggcggagtcctccgaccgcttctccatgttcccgatccgcttcccgcagatctgggagttctacaagaaggcggtggcgtccttctggacggccgaggaggttgacctctctgccgacgcccggcactgggacgaggcgctgtcccccgacgagcgccacttcatctctcacgtgctcgccttcttcgccgcctccgacggcatcgtgctcgagaacctcgcgtcccgcttcatgtccgacgtgcaggtcgccgaggcgcgggccttctacggcttccagatcgccatcgagaacatccactcggagatgtactcgctgctgctcgagacctacatccgcgacgacgtcgagaaggaccgcctcttccgcgccatcgatacggtgcccgcggtccggcgcaaggcggactgggccatgcgctggatcgacggcggggagcgcttcgccgagcgcctcgttgccttcgcctgcgtcgagggcatcttcttctcgggctccttctgcgccatcttttggctgaagaagcgcgggctcatgccgggcctcaccttctccaacgagctcatctcccgcgacgagggcctgcactgcgatttcgcctgcctcctctacgatgtcctacgcagcaagctcgacgaggcccgcgtgcgcacgatcgtcgctgacgccgtcgacatcgagcgcgagttcgtctgcgacgccctccctgtctccctcgtcggcatgaacggggacctcatgagccagtacatcgagttcgtggccgaccgcctgctcatggcgctcgggtgcaagaagatgtacaacgtgacctga

SEQ ID NO: 228 - protein, 315 aa, Zea mays
MLAHLHKPTQKPPNFTLDKPYPNPLTMPSTPTLVPPCDAVEPLLAESSDRFSMFPIRFPQIWEFYKKAVASFWTAEEVDLSADARHWDEALSPDERHFISHVLAFFAASDGIVLENLASRFMSDVQVAEARAFYGFQIAIENIHSEMYSLLLETYIRDDVEKDRLFRAIDTVPAVRRKADWAMRWIDGGERFAERLVAFACVEGIFFSGSFCAIFWLKKRGLMPGLTFSNELISRDEGLHCDFACLLYDVLRSKLDEARVRTIVADAVDIEREFVCDALPVSLVGMNGDLMSQYIEFVADRLLMALGCKKMYNVT

SEQ ID NO: 229 - DNA, 666 bp, Zea mays
  CDS (1)..(666)
atgagcgaggtgttcgagggctacgagcggcagtactgcgaggcctccgcctcgctctcccgcaagtgcaccgctgcatccgccctcgatggagagaggaagaagcagaagctctccgagatccagtccggcgttgaggaagctgaatcgctgattcggaagatggacctggaggcaaggagcctacagcctagcattaaggctggtttgcttgcaaagctgagggagtataaatctgacctcaacaacgtcaagagtgagctcaagaggatatctgcgcccaatgccaggcaggctacccgggaggagctcctggagtctggaatggctgatactctcgcggtgtctactgatcagaggggaagattgatgatgacaactgaaagactgaatcagtccactgacagaattaaagagagccgaagaactatgttggagacagaagaacttggtgtctcgattcttcaggaccttcaccaacagaggcagtcactactacatgctcatactactttgcacggagttgatgataacattggcaagagcaagaagatcctggctgcaatgtcaaagaggatggataggaacaagtggatcattgggggaatcatcacggctctcgctctggccatccttttcatactctacttcaagctcgctcattga

SEQ ID NO: 230 - protein, 221 aa, Zea mays
MSEVFEGYERQYCEASASLSRKCTAASALDGERKKQKLSEIQSGVEEAESLIRKMDLEARSLQPSIKAGLLAKLREYKSDLNNVKSELKRISAPNARQATREELLESGMADTLAVSTDQRGRLMMTTERLNQSTDRIKESRRTMLETEELGVSILQDLHQQRQSLLHAHTTLHGVDDNIGKSKKILAAMSKRMDRNKWIIGGIITALALAILFILYFKLAH

SEQ ID NO: 231 - DNA, 1059 bp, Zea mays
  CDS (1)..(1059)
atgataccccaccctacgaatcttccaacccctccgacgatgccttccgcgccggcgctcgtccccgcgtgcgacatgcaggagccgttgctggcggagtcgtccgaccgcttctccatgttcccgatccggtacccgcagatttgggagttctacaagaaggcggtggcgtccttctggactgccgaggaggtggacctctccgcggacgcgcgccactgggacgcggccctctcccccgacgagcgccacttcatctcccacgtgctcgccttcttcgccgcctccgacggcatcgtgctcgagaacctcgcctcccgcttcatgtccgatgtccaggtcgccgaggcgcgcgccttttacggcttccaaatcgccatcgagaacatccactcggagatgtactcgctgctgctcgagacctacatccgcgatggcaccgagaaggaccgcctcttccgcgccatcgaaaccgtccccgccgtacgccgcaaggccgactgggccatgcgctggatcgacggcggggagcgctttgccgagcgcctcgttgccttcgcctgcgtcgagggcatcttcttctcgggctccttctgcgccatcttctggctcaagaagcgcggcctcatgccgggcctcactttctctaatgagctcatctcccgggacgagggcctccactgcgacttcgcctgcctcctttatgacctccttcggggcaagctcgatgagtcccgcgtccgcgagatcgttgccgacgccgtcgacatcgagcgtgagttcgtttgcgacgcgctccccgtcgcgctggtcggaatgaacggcgggctcatgagccagtacatcgagttcgtcgccgaccgcctgctcatggcgctggggcacaggaagatgtacaacgtcgccaaccccttcgactggatggagctcatttccctgcagggcaagactaacttctttgagaagcgcgtcggggagtaccagaaggcgtccgtaatgtccagcctcaacggcggcgctgctgcaaaccataccttcagcatcgacgaggacttctga

SEQ ID NO: 232 - protein, 352 aa, Zea mays
MIPHPTNLPTPPTMPSAPALVPACDMQEPLLAESSDRFSMFPIRYPQIWEFYKKAVASFWTAEEVDLSADARHWDAALSPDERHFISHVLAFFAASDGIVLENLASRFMSDVQVAEARAFYGFQIAIENIHSEMYSLLLETYIRDGTEKDRLFRAIETVPAVRRKADWAMRWIDGGERFAERLVAFACVEGIFFSGSFCAIFWLKKRGLMPGLTFSNELISRDEGLHCDFACLLYDLLRGKLDESRVREIVADAVDIEREFVCDALPVALVGMNGGLMSQYIEFVADRLLMALGHRKMYNVANPFDWMELISLQGKTNFFEKRVGEYQKASVMSSLNGGAAANHTFSIDEDF

SEQ ID NO: 233 - DNA, 852 bp, Zea mays
  CDS (1)..(852)
atgggccgacaacgctctctaccgtccgagaccccaagcaccagcgcggcggcggcggcggcggcgaccatggctgtcggaaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttggggtatgaattttaccactgataaactcagatccctagtgaagaagtggcagacattaatcgaagcccatgttgatgtcaagacaaccgacaactacatgttgcgtttgttctgcatcggcttcaccaagaggcgcccaaaccaagtcaagagaacctgctatgctcaggcatcccagatccgtcagatccgccgtaagatggttgagattatgatcaaccaggcttctacatgtgacctgaaagaacttgtttcgaagttcattccagaagttattggtaaggagattgagaagtctacctccagcatcttcccacttcaaaacgtcttcatccgcaaggtgaagatactcaaggcccccaagttcgatcttgggaagctcatggaggttcatggcgactacaaagaggatgttggtgtgaagcttgagaggcctgtcgagggagatgaggctgggcaggaggttgctgctgccgagtga

SEQ ID NO: 234 - protein, 283 aa, Zea mays
MGRQRSLPSETPSTSAAAAAAATMAVGKNKRISKGKKGGKKKTVDPFSKKDWYDIKAPSVFSVRNIGKTLVSRTQGTRIASEGLKHRVFEVCLADLQGDEDQAYRKIRLRAEDVQGRNVLTNFWGMNFTTDKLRSLVKKWQTLIEAHVDVKTTDNYMLRLFCIGFTKRRPNQVKRTCYAQASQIRQIRRKMVEIMINQASTCDLKELVSKFIPEVIGKEIEKSTSSIFPLQNVFIRKVKILKAPKFDLGKLMEVHGDYKEDVGVKLERPVEGDEAGQEVAAAE

SEQ ID NO: 235 - DNA, 588 bp, Zea mays
  CDS (1)..(588)
atgttcgtgatttcgccgccggaaagccgagggagagggagcgagatggggttcgtcggcgacacgatggagtcaatccgctccatgcagatccgccaagtgctcatgcagatcatcagcctcggtatgattgttacctctgcattaatcatatggaagggtttgatagttttcacggggagcgagtcaccagttgtagtggtgctctcgggtagcatggagcctggatttaaaaggggtgatatcctgtttttgcatatgagcaaagatcctattcgcacaggagaaatagttgttttcaatatcgatggtcgtgagattccaattgtccaccgagtgattaaggtccatgaacgtcaggacactgcagaagtggacatcctcaccaaaggtgacaataattttggggatgaccgactattatatgcacatggccagctttggctccagcaacaccacattatgggacgtgcggtgggctaccttccatatgttggctgggttacaattatcatgactgagaaaccatttattaagtacctgctgattggcgcactgggcttgctggtcataacgtcgaaagattga

SEQ ID NO: 236 - protein, 195 aa, Zea mays
MFVISPPESRGRGSEMGFVGDTMESIRSMQIRQVLMQIISLGMIVTSALIIWKGLIVFTGSESPVVVVLSGSMEPGFKRGDILFLHMSKDPIRTGEIVVFNIDGREIPIVHRVIKVHERQDTAEVDILTKGDNNFGDDRLLYAHGQLWLQQHHIMGRAVGYLPYVGWVTIIMTEKPFIKYLLIGALGLLVITSKD

SEQ ID NO: 237 - DNA, 483 bp, Zea mays
  CDS (96)..(96): n means a or g or c or t/u
atgcgtttttcatccgccttcgcctccaaccgcgtgcgctccacgcctcctccaggaaagcgagagcttctgcataagaacaacaaatcaaaagcngtgatcagctcggtgccaacaaaacctcaacaaccaagtttcatgtctgatctcgacgtccagcttccatctgcctttgatccgtttgctgaggcaaatgctgaggactctggtgctggtcctggaacgaaggattatgtgcatgtgcgcatccagcagcgcaacggcagaaagagtctgactacagtccagggtctgaagaaagagttcagctataacaagatcctcaaggatctgaagaaggaattctgctgcaatggtactgtagttcaggacccagagctaggccaggtcattcagctccaaggtgatcagcgcaagaatgttgctactttcctagttcaggctgggattgcgaagaaagagaacatcaagattcacgggtga

SEQ ID NO: 238 - protein, 160 aa, Zea mays
MRFSSAFASNRVRSTPPPGKRELLHKNNKSKAVISSVPTKPQQPSFMSDLDVQLPSAFDPFAEANAEDSGAGPGTKDYVHVRIQQRNGRKSLTTVQGLKKEFSYNKILKDLKKEFCCNGTVVQDPELGQVIQLQGDQRKNVATFLVQAGIAKKENIKIHG

SEQ ID NO: 239 - DNA, 456 bp, Zea mays
  CDS (1)..(456)
atgcgcggggactcgcatcagagcggcgccggcctacaaccgttttcgtgctcacacacccaaaccttagtcgcgatcaggccccaaggactcgagatgaagtcgagggcacggtccaccgccggcgactccaggctctcggtgaggaagaccaaggctgagaaggacccaaacaagcccaagaggcctccgagcgcgttcttcgtcttcatggaggagttcaggaaggactacaaggagaagcaccccaatgtgaagcaagtctccctgattggcaaggctggtggtgacaagtggaagtccctgtctgatgccgagaaggctccctacgtgtctaaggcagagaagctcaaggctgagtacaccaagaagatcgacgcttacaacaacaagcagtctggagaccccacggcgtctggtgattccgacaagtccaagtccgagggtgacgagtga

SEQ ID NO: 240 - protein, 151 aa, Zea mays
MRGDSHQSGAGLQPFSCSHTQTLVAIRPQGLEMKSRARSTAGDSRLSVRKTKAEKDPNKPKRPPSAFFVFMEEFRKDYKEKHPNVKQVSLIGKAGGDKWKSLSDAEKAPYVSKAEKLKAEYTKKIDAYNNKQSGDPTASGDSDKSKSEGDE

SEQ ID NO: 241 - DNA, 786 bp, Zea mays
  CDS (1)..(786)
atggccgaccgccgaccgccgacgatgcctcccaaggccaagaaggacgctgcgccgtctgagcgccccatccttggacgcttctcctcccacctcaagatcgggatcgttgggttgccaaatgttggcaaatcaacttttttcaacatagtaacaaagttggctatcccagctgagaattttcctttctgtaccatcgaaccaaatgaagcacgggtgaatgttccagatgaacggtttgattggctctgcaaactttacaagccaaagagtgaggtgcctgcatatcttgaagtaactgacatagctgggcttattagaggtgctcatgctggggatggtctgggcaatgcattcctctcacatatacgtgctgttgatggaatcttccatgtcctaagagcatttgaagacgcagaaattactcatgttgacgatacagtagatcctgttagagacatggaaactattagtgaagagctcagactaaaggatatagagttcatgaaaaagaaacttgaggaccttgataagtcaatgaagaggagcaatgataagctgctcaaaattgagcatgaattatgtgagagggtcataggccatcttgaggaagggaaagatgtccgtttaggggattggaaagctgctgacattgagatcttgaatacattccagctactttcagctaagccagttgtctatttggaacatggtggtgaaaccatacttcctttcagctgtgcttttgaacagaaactagtggacatgccagaagatgaagcctga

SEQ ID NO: 242 - protein, 261 aa, Zea mays
MADRRPPTMPPKAKKDAAPSERPILGRFSSHLKIGIVGLPNVGKSTFFNIVTKLAIPAENFPFCTIEPNEARVNVPDERFDWLCKLYKPKSEVPAYLEVTDIAGLIRGAHAGDGLGNAFLSHIRAVDGIFHVLRAFEDAEITHVDDTVDPVRDMETISEELRLKDIEFMKKKLEDLDKSMKRSNDKLLKIEHELCERVIGHLEEGKDVRLGDWKAADIEILNTFQLLSAKPVVYLEHGGETILPFSCAFEQKLVDMPEDEA

SEQ ID NO: 243 - DNA, 1059 bp, Zea mays
  CDS (1)..(1059)
atgcataccccaccctacgatcttccaacccctccgacgatgccttccgcgccggcgctcgtccccgcgtgcgacatgcaggagccgttgctggcggagtcgtccgaccgcttctccatgttcccgatccggtacccgcagatttgggagttctacaagaaggcggtggcgtccttctggactgccgaggaggtggacctctccgcggacgcgcgccactgggacgcggccctctcccccgacgagcgccacttcatctcccacgtgctcgccttcttcgccgcctccgacggcatcgtgctcgagaacctcgcctcccgcttcatgtccgatgtccaggtcgccgaggcgcgcgccttttacggcttccaaatcgccatcgagaacatccactcggagatgtactcgctgctgctcgagacctacatccgcgatggcaccgagaaggaccgcctcttccgcgccatcgaaaccgtccccgccgtacgccgcaaggccgactgggccatgcgctggatcgacggcggggagcgctttgccgagcgcctcgttgccttcgcctgcgtcgagggcatcttcttctcgggctccttctgcgccatcttctggctcaagaagcgcggcctcatgccgggcctcactttctctaatgagctcatctcccgggacgagggcctccactgcgacttcgcctgcctcctttatgacctccttcggggcaagctcgatgagtcccgcgtccgcgagatcgttgccgacgccgtcgacatcgagcgtgagttcgtttgcgacgcgctccccgtcgcgctggtcggaatgaacggcgggctcatgagccagtacatcgagttcgtcgccgaccgcctgctcatggcgctggggcacaggaagatgtacaacgtcgccaaccccttcgactggatggagctcatttccctgcagggcaagactaacttctttgagaagcgcgtcggggagtaccagaaggcgtccgtaatgtccagcctcaacggcggcgctgctgcaaaccataccttcagcatcgacgaggacttctga

SEQ ID NO: 244 - protein, 352 aa, Zea mays
MHTPPYDLPTPPTMPSAPALVPACDMQEPLLAESSDRFSMFPIRYPQIWEFYKKAVASFWTAEEVDLSADARHWDAALSPDERHFISHVLAFFAASDGIVLENLASRFMSDVQVAEARAFYGFQIAIENIHSEMYSLLLETYIRDGTEKDRLFRAIETVPAVRRKADWAMRWIDGGERFAERLVAFACVEGIFFSGSFCAIFWLKKRGLMPGLTFSNELISRDEGLHCDFACLLYDLLRGKLDESRVREIVADAVDIEREFVCDALPVALVGMNGGLMSQYIEFVADRLLMALGHRKMYNVANPFDWMELISLQGKTNFFEKRVGEYQKASVMSSLNGGAAANHTFSIDEDF

SEQ ID NO: 245 - DNA, 480 bp, Zea mays
  CDS (1)..(480)
atgctccctcagatcctccctaagattgccatggcggaccagctcaccgacgaccagatcgccgagttcaaggaagcattcagcctcttcgacaaggacggcgacggctgcatcaccaccaaggaacttggaactgtgatgcgctcgttggggcagaaccctactgaggctgagcttcaggacatgatcaacgaggttgatgctgatggcaatggaaccatcgacttccctgagtttctcaacctgatggcacgcaagatgaaggacaccgactctgaggaggagctcaaggaggccttccgcgtgttcgacaaggaccagaacggcttcatctctgctgctgagcttcgacatgtcatgaccaacctaggtgagaagctgacggacgaggaggtggatgagatgattcgtgaagccgacgtggacggtgatggccagatcaactacgaggagttcgtgaaggtgatgatggccaagtga

SEQ ID NO: 246 - protein, 159 aa, Zea mays
MLPQILPKIAMADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 247 - DNA, 852 bp, Zea mays
  CDS (1)..(852)
atgccccgggcgtgggctgaagcgcaagtgggctgcatcgactccgccactcggatggggcggaagaagcggctcgagagcgagtacgagctcggcgccgagatcggccagggcaagttcggctccgtccggatctgccgcgctaaggtcggcggcgacgagttcgcctgcaaggagctgcccaagaacggcgaggagacggtgcaccgcgaggtggagatcatgcagcacctctcgggccacccgggcgtcgtcacgctcagggccgtcttcgaggatgccgacaagttttacctcgtcatggagctctgcagcggggggaggttgctcgatgagatcgccagggaggggaagttttccgagcagcgtgctgccattgtgatcaaggatctcatggcagtgctcaagtactgccacgagatgggtgttgtgcacagggacgttaagccggagaatattttgcttaccaaggctgggaaagtgaagcttgctgatttcggactcgctgcacgggtcactaatggtcagaaaatgtttggtgttgctgggagccctgcatatgtggcacctgaagttctttctggaagctattcggagaaggttgatatatggggtgccggtgtgctactacatgtactactacttggttcacttccatttcaagggggctctctggacgccgttttcgagtccataaagacacttgaacttgatttcagcagcaccccactggaatcaatatcagttcttggacgggatcttattgggcgaatgctaaatcgagatgtctcttgcagaatgactgctgatgaagttcttagtcacccatgggtcgtattttacacagaatga

SEQ ID NO: 248 - protein, 283 aa, Zea mays
MPRAWAEAQVGCIDSATRMGRKKRLESEYELGAEIGQGKFGSVRICRAKVGGDEFACKELPKNGEETVHREVEIMQHLSGHPGVVTLRAVFEDADKFYLVMELCSGGRLLDEIAREGKFSEQRAAIVIKDLMAVLKYCHEMGVVHRDVKPENILLTKAGKVKLADFGLAARVTNGQKMFGVAGSPAYVAPEVLSGSYSEKVDIWGAGVLLHVLLLGSLPFQGGSLDAVFESIKTLELDFSSTPLESISVLGRDLIGRMLNRDVSCRMTADEVLSHPWVVFYTE

SEQ ID NO: 249 - DNA, 447 bp, Zea mays
  CDS (1)..(447)
atgtcgtgctctctgaagaggaggtactctttatcagctgcaagcttaacttcagttccaccatactctggcaggagaacagtgtcaccttccttcagagcaactgggatcagattgcctgccttgtcgcgctcaccagggccaacagccaccactttagcagcattcagctgcttggatgtttccgggaggaggatgccgccggcggtcttcttgggctgcaccagcttctcaaccagcacccggttcagagatgggagcagcctcttcgccatcgccgccgtcctcttgttacccttcttcttgcgcagtaagccaaaaggaagaaaaaaaaaaaactcgaagcttccactcgcctcaacaccaaccgatcagccggaggttttagggttttatggacagacgccggcgcagcggaaaaattacgagcctgcccctttgagatga

SEQ ID NO: 250 - protein, 148 aa, Zea mays
MSCSLKRRYSLSAASLTSVPPYSGRRTVSPSFRATGIRLPALSRSPGPTATTLAAFSCLDVSGRRMPPAVFLGCTSFSTSTRFRDGSSLFAIAAVLLLPFFLRSKPKGRKKKNSKLPLASTPTDQPEVLGFYGQTPAQRKNYEPAPLR

SEQ ID NO: 251 - DNA, 342 bp, Zea mays
  CDS (1)..(342)
atgatcgaaaatctcaagacctacgaccctttcgccgaagccgacgaggacaccggagaaaccaagcagacgcagaattacatccatatacgcattcagcagcgtaatggacgtaagactttgaccactgttcagggtctccccaagaaatttgaccagaagaagattcttaaggtcatcaagaagaagtttgcctgcaatggcactatcgtcaacgactccgagatgggagaggtgatccagctccagggtgatcagcgcaaagatgttcaggaatttctcatcgacaagaaggaaggcctcgagctagatgccaagaccattaaggtccacggtttctga

SEQ ID NO: 252 - protein, 113 aa, Zea mays
MIENLKTYDPFAEADEDTGETKQTQNYIHIRIQQRNGRKTLTTVQGLPKKFDQKKILKVIKKKFACNGTIVNDSEMGEVIQLQGDQRKDVQEFLIDKKEGLELDAKTIKVHGF

SEQ ID NO: 253 - DNA, 729 bp, Zea mays
  CDS (8)..(8): n means a or g or c or t/u
  CDS (594)..(594): n means a or g or c or t/u
  CDS (629)..(629): n means a or g or c or t/u
  CDS (642)..(642): n means a or g or c or t/u
  CDS (698)..(698): n means a or g or c or t/u
atggccangcgccgccgcaccctgctcaaggtcatcatcctcggcgacagcggggttgggaagacgtctttgatgaaccaatatgtgaacaagaagttcagcaaccagtacaaggctacgattggggcggatttcctcaccaaggaggtgcagttcgaggacaggctcttcactctgcaaatatgggacactgctggtcaggaaaggtttcagagtcttggcgttgcattctaccggggagcagattgttgtgtcctagtctatgatgttaattctatgaaatcgtttgataatcttcacaactggcgtgaagagtttctaattcaggcgagcccatcagatcctgacaatttcccttttgttctgttgggtaacaaagttgatgtagatggtgggaacagccgtgtggtgtcggagaaaaaggcaaaggcatggtgcgcctctaaagggaacatcccgtactttgagacgtctgctaaggatggaacgaacgtggaagatgccttccagtgtattgtaaagaatgctctgaagaatgaaccggaggaagaattgtatgtgccagataccgtggatgtggtaggtggcaaccgnggctcagagatcatctggctgctgttaagacatgnaggcatccacganggcgtggtgatcatcatcggctatgcagtgaccaaacaatacctcaacattgctgnggcctccatggttatctacgtgtccgtatga

SEQ ID NO: 254 - protein, 242 aa, Zea mays
  misc_feature (3)..(3): Xaa can be Lys or Thr or Arg or Met
  misc_feature (210)..(210): Xaa can be Ala or Glu or Gly or Val
  misc_feature (214)..(214): Xaa can be Asp or Glu
  misc_feature (233)..(233): Xaa can be Ala or Glu or Gly or Val
MAXRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLHNWREEFLIQASPSDPDNFPFVLLGNKVDVDGGNSRVVSEKKAKAWCASKGNIPYFETSAKDGTNVEDAFQCIVKNALKNEPEEELYVPDTVDVVGGNRGSEIIWLLLRHXGIHXGVVIIIGYAVTKQYLNIAXASMVIYVSV

SEQ ID NO: 255 - DNA, 303 bp, Zea mays
  CDS (1)..(303)
atgcgaaggcaagagaagaaaaagccaaagaagaaaaaagatccgaatgctccgaaacgagccatgaccccgttcatgtatttctcaatggctgagcgaggaaacatgaagagcagcaacccagatttgcctacgactgagatcgcaaagaagcttggggagatgtggcaaaagatgtcaggcgaagagaaacagccttacatccagcaggcccaggtcgacaagaaacgttatgaaaaagaatccgctgtctatcgcggtgaagctacagtcgatgtggattctgggaacgagtctgactga

SEQ ID NO: 256 - protein, 100 aa, Zea mays
MRRQEKKKPKKKKDPNAPKRAMTPFMYFSMAERGNMKSSNPDLPTTEIAKKLGEMWQKMSGEEKQPYIQQAQVDKKRYEKESAVYRGEATVDVDSGNESD

SEQ ID NO: 257 - DNA, 525 bp, Zea mays
  CDS (1)..(525)
atggacgccgacgccgcccgagaagaatttgcggatggattcgctgcgcaggtgttggagtcgattcaggcgatgcagatccgccccgtggtcgcccaaatcatcaccctagggatgatcctaacttcggcattgatcctatggaaaggattggtcgtcgtaacagggagtgagtcgccggttgtggtggttctatctggaagcatggagcctgggtttcgaaagggtgatgtcctgtttctgcacatgaataaggaccctgtccgcacaggagacatagttgttttcaatgtcgagggccgtgatattccaattgtccatcgtgtgatcaaggttcatgagcgccatgatacggtggactctgacattctcacgaaaggtgacaataatcccggggatgaccgagtcctgtacgcacatgggcagctttggctcagcgacacacatcattggacgggctgttggctatctgccttatgctgggtggcttacaatcgtcatgacggagaaaccagtcctcaatga

SEQ ID NO: 258 - protein, 174 aa, Zea mays
MDADAAREEFADGFAAQVLESIQAMQIRPVVAQIITLGMILTSALILWKGLVVVTGSESPVVVVLSGSMEPGFRKGDVLFLHMNKDPVRTGDIVVFNVEGRDIPIVHRVIKVHERHDTVDSDILTKGDNNPGDDRVLYAHGQLWLSDTHHWTGCWLSALCWVAYNRHDGETSPQ

SEQ ID NO: 259 - DNA, 1413 bp, Zea mays
  CDS (1)..(1413)
atgcacgagggttcactgagcacgttacgttgtaatggtgaaattagcagatttgcaagccctggcgtcgagttgatgaggtccatgttctctactgtagtgactgatccgatcaaagatattggaagaggtggtccaatggtggaatatgagaggagaatagcatcaggagagctagtagacggtgatagctttcaggttgatacaattcaacaattacaaaggctctatgaggagttgattgagaatgaagaagactgtcagctggatagatataagtcatctgagaaatcaggccggagtcgatggctatggtcccgcctcattactcagccttctacgtatgctcctattaagggcctttacctctatggtggtgttggtacagggaagacaatgcttatggacttgttctatgaacagctgccatctaattggagaaaaaaacgtattcactttcatgatttcatgttgaatgtacatagtcgtcttcagatgcacaaaggtgtttcagatccccttgatgttgtagcagctgagatttcagatgaggccatcatattatgtcttgatgagtttatggtaactgatgttgctgatgctatgattctgaaccgtctgttcagacaattgttcagcaaaggcgttattcttgtttcgacttctaaccgtgctccagataagctttatgaaggtggcttacaacgggaccttttcttgccatttattgacaccttgaaagaaagatgcatcgtgcatgccattggatctgcggtggactatcgtcaactgggttctgctgaacaaggtttctattttgtcggaaaacattacagtacgcttctgaaacagaagctccagtctttaattggagatgaggaacccagcccacaaactgttgaagtaattatgggaaggaaattacaggtttctctgggagcaaatggctgtgcatattttccttttgaagatctctgtgatagacctttaggtgcagcagattactttggactcttcaaaaaatttcacaccctggcacttgatggtgttccaaagtttgggtctagtaacagaacagcagcttatcggttcgtcacactgattgatgttatgtacgagaacaaagcaaggctgttatgtacagccgaggctggaccagtaggactgtttgagaatatcgtgactgttgctgaagcacggaaggtttcaccaagatcttcgcgctcacagaaaagcgacgacactgacctatgcgtggacaatgagcttggatttgccaaggatcgtacgattagcaggttgacagagatcaacagcagagaatatttggaggacttcgaaatgagattgaggcaacagcagcagctgcccttgcaagctctagataatggtggtgatgttgtactagcatga

SEQ ID NO: 260 - protein, 470 aa, Zea mays
MHEGSLSTLRCNGEISRFASPGVELMRSMFSTVVTDPIKDIGRGGPMVEYERRIASGELVDGDSFQVDTIQQLQRLYEELIENEEDCQLDRYKSSEKSGRSRWLWSRLITQPSTYAPIKGLYLYGGVGTGKTMLMDLFYEQLPSNWRKKRIHFHDFMLNVHSRLQMHKGVSDPLDVVAAEISDEAIILCLDEFMVTDVADAMILNRLFRQLFSKGVILVSTSNRAPDKLYEGGLQRDLFLPFIDTLKERCIVHAIGSAVDYRQLGSAEQGFYFVGKHYSTLLKQKLQSLIGDEEPSPQTVEVIMGRKLQVSLGANGCAYFPFEDLCDRPLGAADYFGLFKKFHTLALDGVPKFGSSNRTAAYRFVTLIDVMYENKARLLCTAEAGPVGLFENIVTVAEARKVSPRSSRSQKSDDTDLCVDNELGFAKDRTISRLTEINSREYLEDFEMRLRQQQQLPLQALDNGGDVVLA

SEQ ID NO: 261 - DNA, 639 bp, Zea mays
  CDS (1)..(639)
atggctgctgaatcagagaacggcaactgcaaagcttgggcagcgagagatccttctggagttctctcaccacacagttttaaccgcagagcagtgcaaagcggcgatgtttcgctgaagatcatatactgtggagtctgttatgcagacgttgcttggacgcggaataagctcaatgattcaaaatatcctttggttcctgggcatgagatagctggagttgtaactcaggttggtgcagatgtcaaaggctttaaagtgggtgaccatgtaggtgttggaacatatgtgaactcttgccgtgattgtgagaactgcaatatctctctagacaaccattgcccaaaagcagtttatactttcaatggcattgatacagatggaactgtcacaaaggggggttactccactcacattgtagtccatgaaaggtattgcttcaaaatacccgatggctaccctttggcgaaggcagcacctcttctgtgtgctggaataaccgtgtatactccaatgatgcgacacaacatgaaccaacctggaaagtcacttggggtcattggtcttggtggtctgggtcacatggctgtgaaatttggtaaagcatttggtcttaaggtcacagttttcagtacctga

SEQ ID NO: 262 - protein, 212 aa, Zea mays
MAAESENGNCKAWAARDPSGVLSPHSFNRRAVQSGDVSLKIIYCGVCYADVAWTRNKLNDSKYPLVPGHEIAGVVTQVGADVKGFKVGDHVGVGTYVNSCRDCENCNISLDNHCPKAVYTFNGIDTDGTVTKGGYSTHIVVHERYCFKIPDGYPLAKAAPLLCAGITVYTPMMRHNMNQPGKSLGVIGLGGLGHMAVKFGKAFGLKVTVFST

SEQ ID NO: 263 - DNA, 612 bp, Zea mays
  CDS (1)..(612)
atgtctcctcgcctgctcatccgccgctgcttcccttctctgggctcggagaaccggagagaagcgcgcgcggccatggcgtccagcgcctctcggttcatcaagtgcgtcacggtcggcgacggtgccgtgggcaagacatgtatgctcatctgctacaccagcaacaagttccccactgactacatacctacggtgttcgacaatttcagtgcaaatgtagttgtggatggcaccactgtgaatttgggcctttgggataccgctgggcaggaagattacaaccgcctgaggcctctaagctaccgaggtgcagatgttttcgtgcttgcattctcacttgtgagccgagctagctatgagaatatcatgaagaagtggataccagagcttcaacattatgcacctggggtgcccgttgttttggcaggcacaaaattggatcttcgtgaagacaagcactacttgatggaccatcctggattggtgcctgttaccactgcacagggggaggaacttcgtagacaaattggtgctatgtattacattgaatgcagctcaaagacacagcagaatgtcaaagctgtgttcgatgctgccatcaaggtatga

SEQ ID NO: 264 - protein, 203 aa, Zea mays
MSPRLLIRRCFPSLGSENRREARAAMASSASRFIKCVTVGDGAVGKTCMLICYTSNKFPTDYIPTVFDNFSANVVVDGTTVNLGLWDTAGQEDYNRLRPLSYRGADVFVLAFSLVSRASYENIMKKWIPELQHYAPGVPVVLAGTKLDLREDKHYLMDHPGLVPVTTAQGEELRRQIGAMYYIECSSKTQQNVKAVFDAAIKV

SEQ ID NO: 265 - DNA, 828 bp, Zea mays
  CDS (1)..(828)
atgagttcacaagggccaccacggcgcgcccaaaggcccccaaccccaaccttgcaggaaaagagagagagagagacgaccccccaaatcggaatccgcacacccccatccatggccgccgccctgctccgccgctcgccggcggtgcgcgcgctcctctcgccggcactctcgtcccgcctcgtcgcgtccaagccccactcctcgtcccccgcgccgccgccacctgccaaggccgcctccagcacgaagaccttctcgatctaccggtgggacccggactcgccgtcgacgaagccgcacctcaaggactaccaggtggacctgtccgactgcgggccgatggtgctggacgcgctgctcaagatcaagaacgagcaggacccgtcgctcaccttccgccgcagctgccgcgagggcatctgcgggagctgcgccatgaacatcgacggcgacaacggcctcgcctgcctcaccaagatctccggcgcctcctccgcgtccacggtctcgccgctgccccacatgttcgtcgtcaaggacctggtggtggacatgaccaacttctacagccagtacaagagcgtcgagccatggctcaagcgcaaggaccagcccccgcagcagggcaaggagatcccgcagaccaaggccgaccgggccaagctcgacggcatgtacgagtgcatcctctgcgcctgctgctccacctcctgcccgtcctactggtggaacccggaggagtacctcggcccggccgcgctgctccacgccaacaggtataccaccatcaccgccacatcgcatcctttgtactgtgatggatga

SEQ ID NO: 266 - protein, 275 aa, Zea mays
MSSQGPPRRAQRPPTPTLQEKRERETTPQIGIRTPPSMAAALLRRSPAVRALLSPALSSRLVASKPHSSSPAPPPPAKAASSTKTFSIYRWDPDSPSTKPHLKDYQVDLSDCGPMVLDALLKIKNEQDPSLTFRRSCREGICGSCAMNIDGDNGLACLTKISGASSASTVSPLPHMFVVKDLVVDMTNFYSQYKSVEPWLKRKDQPPQQGKEIPQTKADRAKLDGMYECILCACCSTSCPSYWWNPEEYLGPAALLHANRYTTITATSHPLYCDG

SEQ ID NO: 267 - DNA, 336 bp, Zea mays
  CDS (1)..(336)
atgctgaggacgatgatgaccgaatccccgcggaggaacatcttgcttatgaacctgtccttgttcaccgggagagccttcttcttgcctttaccggtctttggtacctcggtccacatctcacgaacgttctcaagaaccatgttgcagtgccgatcgaaggctcgcacgcgaccaagcaacttcttgttgttccggcagttgataagaacctgggtattattcttgacgctcatcatgagcaccgagagaggaccggtgctgaactcctcttcctccttttttatgttggtttcttccgcccatgggcgccaattggagccgtcaatactgtga

SEQ ID NO: 268 - protein, 111 aa, Zea mays
MLRTMMTESPRRNILLMNLSLFTGRAFFLPLPVFGTSVHISRTFSRTMLQCRSKARTRPSNFLLFRQLIRTWVLFLTLIMSTERGPVLNSSSSFFMLVSSAHGRQLEPSIL

SEQ ID NO: 269 - DNA, 702 bp, Zea mays
  CDS (1)..(702)
atggaggctccgaccaccggggagcaccggatggggactaccatcgtcggggtctgctacgagggcggcgtcgtcctgggcgccgattccaggaccagcactggaatgtatgtagccaaccgtgcttcagacaagattactcaactgacagacaatgtgtatgtctgtcgctctggatctgctgctgatacacaagtcatttcggattatgtacgctatttcctccaccaacacacaatccagcttggacaaccagctaccgttaaagttgcagccaacttgattaggttgctagcttatcagaacaagaacatgttgcaagctggcatgattgttggaggatgggacaagtacgagggaggccaaattttctcagtccctctcggtggaacgatcttgaagcaaccatttgcaattggaggttcaggttccagttacctatatgctcttcttgatcatgaatggaaagagggaatgagtcaggaagaggcagagaaatttgtggtgaaggtagtttcccttgctatggcccgtgatggtgctagtggaggggttgtccgtacagttacaataaatgcggatggcgtgaagaggaacttttaccctggcgacaagctacccctgtggcacgacgagctggaaccccagaactcgttgcttgatattcttgctgctgggaaccctgatcccatggtgcagtga

SEQ ID NO: 270 - protein, 233 aa, Zea mays
MEAPTTGEHRMGTTIVGVCYEGGVVLGADSRTSTGMYVANRASDKITQLTDNVYVCRSGSAADTQVISDYVRYFLHQHTIQLGQPATVKVAANLIRLLAYQNKNMLQAGMIVGGWDKYEGGQIFSVPLGGTILKQPFAIGGSGSSYLYALLDHEWKEGMSQEEAEKFVVKVVSLAMARDGASGGVVRTVTINADGVKRNFYPGDKLPLWHDELEPQNSLLDILAAGNPDPMVQ

SEQ ID NO: 271 - DNA, 1107 bp, Zea mays
  CDS (1)..(1107)
atgcaccatggacccaaccttccaggaaaaaaaacccggaatccgcacccatccatggccgccgccgccctgctgcgccgctcgccggcggcgcgcgcgctcctctctccggcgctctcgtcccgcctcgtcgcgtccaagccccactcctcctcccccacgcagccgccccccgaggcaaagggcgcctccagcacgaagaccttctcgatctaccggtgggacccggactcgccgtcgaccaagccgcacctcagggactaccaggtggacctgtccgactgcgggccgatggtgctggacgcgctgctcaagatcaagaacgagcaggacccgtcgctcaccttccgccgcagctgccgcgagggcatctgcgggagctgcgccatgaacatcgacggggacaacggcctcgcctgcctcaccaagatctcctccgcctcctcggcgtccaccgtctcgccgctgccccacatgttcgtcatcaaggacctggtggtcgacatgaccaacttctacaaccagtacaagagcgtcgagccgtggctcaagcgcaaggacccgccgccgcagctcggcaaggaggtcccgcagaccaaggccgaccgcgccaagctcgacggcatgtacgagtgcatcctctgcgcctgctgctccacctcctgcccatcctactggtggaaccccgaggagtacctcggcccagccgcgctgctccacgccaataggcttccgctgtgggggacacttatcaaaccaaaacccaacatgttcatgcaccttcaagctcgaggatatcacggggtgtcagagaagagaaacctgcgggaccacaaacgtagactgcttgcagaaaaatatgagctaagaggaaagatgtataaggccgtctgtagggaccctgatcttccattggatatgcgggagaagttccgctataaactgtccaagttgccaagaaatagctccatgacacgccttagaaaccgctgcattttcacaggacggtctcgcgctgtctacaagaaattccgcatgtcccgtatcgtgttccgcacattggcaaacaagggtgaactgatgggcgtaaagaaagcatcgtggtga

SEQ ID NO: 272 - protein, 368 aa, Zea mays
MHHGPNLPGKKTRNPHPSMAAAALLRRSPAARALLSPALSSRLVASKPHSSSPTQPPPEAKGASSTKTFSIYRWDPDSPSTKPHLRDYQVDLSDCGPMVLDALLKIKNEQDPSLTFRRSCREGICGSCAMNIDGDNGLACLTKISSASSASTVSPLPHMFVIKDLVVDMTNFYNQYKSVEPWLKRKDPPPQLGKEVPQTKADRAKLDGMYECILCACCSTSCPSYWWNPEEYLGPAALLHANRLPLWGTLIKPKPNMFMHLQARGYHGVSEKRNLRDHKRRLLAEKYELRGKMYKAVCRDPDLPLDMREKFRYKLSKLPRNSSMTRLRNRCIFTGRSRAVYKKFRMSRIVFRTLANKGELMGVKKASW

SEQ ID NO: 273 - DNA, 402 bp, Zea mays
  CDS (323)..(323): n means a or g or c or t/u
  CDS (330)..(330): n means a or g or c or t/u
  CDS (370)..(370): n means a or g or c or t/u
atgttggggttcctcagcacgatgatgaccgagtcgcccctgaggaacatcttgctgatgaatctatccttgttcacaggcagagccttctttttgcccttgccagtcttggggacctctgtccacatctcccgcacgttctcgagcaccatgttacagtggcgatcaaaagcacgaacccggccaagcagcttcttgttgttgcggcaattgatgagaacctgggtgttgttcttaacactcatcattagtactgacagagggcctgtgctaaattcctcttcctctttcttcccagcctcattctcgtccgccatcgcctnagcctangccctccttctccgcgccggtggcgagtcgctccgggtgngcgttggtgcgctccgagaggcgaaaccttga

SEQ ID NO: 274 - protein, 133 aa, Zea mays
  misc_feature (108)..(108): Xaa can be Leu or Ser
  misc_feature (110)..(110): Xaa can be Tyr
  misc_feature (124)..(124): Xaa can be Ser or Arg or Gly or Cys
MLGFLSTMMTESPLRNILLMNLSLFTGRAFFLPLPVLGTSVHISRTFSSTMLQWRSKARTRPSSFLLLRQLMRTWVLFLTLIISTDRGPVLNSSSSFFPASFSSAIAXAXALLLRAGGESLRVXVGALREAKP

SEQ ID NO: 275 - DNA, 465 bp, Zea mays
  CDS (1)..(465)
atgcagacctctgccatggcggaccagctcaccgacgagcagatcgcggagttcaaggaggccttcagcctcttcgataaggatggcgacggctgcatcactaccaaggagcttggaacggtgatgcgctcccttggccagaaccctaccgaggcagagctgcaggacatgatcaacgaggtcgatgcggatggcaatgggaccatcgacttcccggagctcctgaacctgatggcgaggaagatgaaggacacggactcagaggaggagctcaaggaggccttccgcgtcttcgacaaggaccagaacggtttcatctcggctgccgagctccgccatgtcatgaccaaccttggcgagaagctgaccgacgaggaggtcgacgagatgatccgtgaggccgacgtcgacggcgacggccagatcaactacgaggagttcgtcaaggttatgatggccaagtga

SEQ ID NO: 276 - protein, 154 aa, Zea mays
MQTSAMADQLTDEQIAEFKEAFSLFDKDGDGCITTKELGTVMRSLGQNPTEAELQDMINEVDADGNGTIDFPELLNLMARKMKDTDSEEELKEAFRVFDKDQNGFISAAELRHVMTNLGEKLTDEEVDEMIREADVDGDGQINYEEFVKVMMAK

SEQ ID NO: 277 - DNA, 735 bp, Zea mays
  CDS (73)..(73): n means a or g or c or t/u
atgccgcggcgcgatccgaatcgaatgggagctgcgttcgagagaatgtgtcgggtgggcgccagtgacgcanccggacacttttccccttactcctacacctcagggaacacagccctgaaagatgtggtggtgaaggtgctctactgcgggatctgccacacggacatccaccaggccaagaaccacctcggggcttcaaagtatcctatggtccctgggcacgaggtggtcggcgaggtggtggaggtcgggcccgaggtggccaagtacggcgtcggcgacgtggtaggcgtcggggtgatcgttgggtgctgccgcgagtgcagcccctgcaaggccaacgttgagcagtactgcaacaagaagatctggtcatacaacgacgtctacactgatggacggcccacgcagggtggattcgcctccaccatggtcgtcgaccagaagtttgtggtgaagatcccggcgggtctggctccggagcaagcggcgccgctgctgtgcgctggcgtgacggtgtacagcccgctgaagcactttgggctgacgaccccgggcctccgtggcggcatcctgggcctcggcggcgtgggccacatgggcgtgaaggtagccaaggccatgggccaccacgtgacggtgatcagctcgtcgtccaagaagcgcgcggaggcaatggaccacctcggcgcggacgcgtacctagtgagctcggacgccgcggccaagtga

SEQ ID NO: 278 - protein, 244 aa, Zea mays
  misc_feature (25)..(25): Xaa can be Thr or Pro or Ala or Ser
MPRRDPNRMGAAFERMCRVGASDAXGHFSPYSYTSGNTALKDVVVKVLYCGICHTDIHQAKNHLGASKYPMVPGHEVVGEVVEVGPEVAKYGVGDVVGVGVIVGCCRECSPCKANVEQYCNKKIWSYNDVYTDGRPTQGGFASTMVVDQKFVVKIPAGLAPEQAAPLLCAGVTVYSPLKHFGLTTPGLRGGILGLGGVGHMGVKVAKAMGHHVTVISSSSKKRAEAMDHLGADAYLVSSDAAAK

SEQ ID NO: 279 - DNA, 957 bp, Zea mays
  CDS (130)..(130): m means a or c
  CDS (137)..(137): m means a or c
  CDS (255)..(255): r means g or a
  CDS (388)..(388): m means a or c
  CDS (460)..(460): m means a or c
  CDS (593)..(593): m means a or c
  CDS (797)..(797): r means g or a
  CDS (803)..(803): r means g or a
  CDS (815)..(815): r means g or a
  CDS (836)..(836): r means g or a
  CDS (874)..(874): r means g or a
  CDS (890)..(890): m means a or c
  CDS (895)..(895): k means g or t/u
  CDS (904)..(904): n means a or g or c or t/u
  CDS (907)..(907): r means g or a
  CDS (913)..(913): k means g or t/u
  CDS (917)..(917): r means g or a
  CDS (944)..(944): s means g or c
atgagccgccgacaacgctctctgccgtccgagcccccaagcaccagcgcggcggcgggggcggcggcgcccatggctgtcggaaagaacaagaggatctccaagggaaagaagggtggcaagaaaaagmccgtcgmccctttctctaagaaggattggtatgacatcaaggcaccgtcggtgttcagtgtgcgcaacatcgggaagactctcgtatccaggacacagggtaccaggattgcttctgagggtctraagcacagagtctttgaggtttgcctagctgatcttcagggcgacgaggatcaagcttacaggaaaatcaggctccgtgctgaagatgtgcagggcaggaatgtgctcacaaacttttggggcatgaattttmccactgataaactcagatccctagtgaagaagtggcagacattaatcgaagcccatgttgatgtcaagacamccgacaactacatgttgcgtttgttctgcatcggcttcaccaagaggcgcccaaaccaagtcaagagaacctgctatgctcaggcatcccagatccgtcagatccgccgaaagatggttgagattatgatcamccaggcttctacatgtgacctgaaagaacttgtttcgaagttcattccagaagttattggtaaagagattgagaagtctacctccagcatcttcccacttcaaaacgtcttcatccgcaaggtgaagatactcaaggcccccaagttcgatcttgggaaactcatggaggttcatggcgactacaaagaggatgttggtgtgargcttgrgaggcctgtcgrgggagatgaggctgggcaggrggttgctgctgccgggtggtttgtttgctacttctgtrtctgggcgggtctggmcatgkggttgcttntgrcgtgtkcttrtggdgttgtcttggctacgtgttttcstctggccctgtga

SEQ ID NO: 280 - protein, 318 aa, Zea mays
  misc_feature (44)..(44): Xaa can be Pro or Thr
  misc_feature (46)..(46): Xaa can be Asp or Ala
  misc_feature (130)..(130): Xaa can be Pro or Thr
  misc_feature (154)..(154): Xaa can be Pro or Thr
  misc_feature (198)..(198): Xaa can be Asn or Thr
  misc_feature (266)..(266): Xaa can be Lys or Arg
  misc_feature (268)..(268): Xaa can be Glu or Gly
  misc_feature (272)..(272): Xaa can be Glu or Gly
  misc_feature (279)..(279): Xaa can be Glu or Gly
  misc_feature (292)..(292): Xaa can be Ile or Val
  misc_feature (297)..(297): Xaa can be Asp or Ala
  misc_feature (299)..(299): Xaa can be Gly or Trp
  misc_feature (302)..(302): Xaa can be Met or Leu or Val
  misc_feature (303)..(303): Xaa can be Ala or Thr
  misc_feature (305)..(305): Xaa can be Ala or Ser
  misc_feature (306)..(306): Xaa can be Tyr or Cys
  misc_feature (315)..(315): Xaa can be Arg or Pro
MSRRQRSLPSEPPSTSAAAGAAAPMAVGKNKRISKGKKGGKKKXVXPFSKKDWYDIKAPSVFSVRNIGKTLVSRTQGTRIASEGLKHRVFEVCLADLQGDEDQAYRKIRLRAEDVQGRNVLTNFWGMNFXTDKLRSLVKKWQTLIEAHVDVKTXDNYMLRLFCIGFTKRRPNQVKRTCYAQASQIRQIRRKMVEIMIXQASTCDLKELVSKFIPEVIGKEIEKSTSSIFPLQNVFIRKVKILKAPKFDLGKLMEVHGDYKEDVGVXLXRPVXGDEAGQXVAAAGWFVCYFCXWAGLXMXLLXXCXXGVVLATCFXLAL

SEQ ID NO: 281 - DNA, 678 bp, Zea mays
  CDS (1)..(678)
atgacgaggcagactcctctccgcacacaccctccctacctcgccgtcgccgtcgcatctgccatgggggcgtacaagtacgtctcggagttatggagaaggaagcaatccgacgtgatgcggttcgttcaacgcgtgcgctgttgggagtacaggcagcagccggccatcgtccgcctcacaaggcccacccgccccgacaaggcccgccgcctcggcttcaaggccaagcaggggtatgttgtttaccgcgtccgtgtgaggcgtggtggcaggaagaggcctgtgccgaagggtattgtctatggcaagcccaagcaccagggtatcacccagctcaagttccagaggaacaagagatctgttgctgaggaacgggctggacgaaagcttggtggactcagggttctcaactcctactgggtgaatgaggatagcacctacaagtactttgagatcatcctggttgatgtggcccacactgccatccgcaacgacccaagaatcaactggctatgcaatcctgtgcacaagcatcgtgagctccgtggtctcacctctgcaggcaagaagttccgtggcctgcgtggcaagggccacactcaccacaagaacaggccgtcgaggagggccacctggaagcgcaaccagaccctgtccctccgccgctaccgttga

SEQ ID NO: 282 - protein, 225 aa, Zea mays
MTRQTPLRTHPPYLAVAVASAMGAYKYVSELWRRKQSDVMRFVQRVRCWEYRQQPAIVRLTRPTRPDKARRLGFKAKQGYVVYRVRVRRGGRKRPVPKGIVYGKPKHQGITQLKFQRNKRSVAEERAGRKLGGLRVLNSYWVNEDSTYKYFEIILVDVAHTAIRNDPRINWLCNPVHKHRELRGLTSAGKKFRGLRGKGHTHHKNRPSRRATWKRNQTLSLRRYR

SEQ ID NO: 283 - DNA, 543 bp, Zea mays
  CDS (478)..(478): n means a or g or c or t/u
atgacccttgagatcattgaccacatcatatgggatgggagttacggtctcaatggtggtgccctcgaccatgaagccgggcttgggacccaatggctgcctcttggtgctgataacctcgccgcgctttttggcatccgccttcagctggtcattcttcgccttcctcaggcggaactcttctgtgcagcgggacggctgcacatgctccacacggacatggatacgcttcctgatgatgcgcccattgacctgcttgttgacctcgacgccgatggcgcgcttggtgacgttccagacgcgaccggtgcggccgtggtagaacttgtgcggcatccccttgtggacggcgccgttcaccttgacatcgacgtaatcgccgatcttgtaggtgcggaggtaggtggtgagcgggatgtagcccttcttgcggaaggggcgcgcgaagaggtcgcgcgtccgcgagcgcaggccgtgngccagccggcatcctgtctccacctgcttgtacgcgcggcggaggcggctgaagcgagtgggtga

SEQ ID NO: 284 - protein, 180 aa, Zea mays
  misc_feature (160)..(160): Xaa can be Ser or Arg or Gly or Cys
MTLEIIDHIIWDGSYGLNGGALDHEAGLGTQWLPLGADNLAALFGIRLQLVILRLPQAELFCAAGRLHMLHTDMDTLPDDAPIDLLVDLDADGALGDVPDATGAAVVELVRHPLVDGAVHLDIDVIADLVGAEVGGERDVALLAEGAREEVARPRAQAVXQPASCLHLLVRAAEAAEASG

SEQ ID NO: 285 - DNA, 585 bp, Zea mays
  CDS (1)..(585)
atggttgaggttgaggaagagcagaggaatccattccaggagtgtttaatggcgggaggcaaggaagcgcacgggtgggcagccagggatgtctctggtcacctctccccttaccacttctcacggagggttcagagagacgacgacgtcaccatcaaggtgctcttctgcgggctttgccacactgacctccacgtcatcaagaacgagtttggcaacgccaagtaccccgtcgttcccgggcacgagattgtcggcgtcgtcaccgacgtcggctccggcgtcacaagcttcaagcccggcgacacggtgggcgtgggctacttcgtcgactcctgccgcagctgcgacagctgcagcaaggggtacgagagctactgcccgcagcttcgtggagacgtccaacggcgtgagcctggacgaacgatgacggcggcgccaccaccaagggcggcttctccgacgccctcgtcgtccaccagcgctacgtggtgcgggtcccggccagcctgccgcccgccggggccgcgccgctgctgtgcgccggcgtcaccgtgttcagccccatggtgcagtacggcctga

SEQ ID NO: 286 - protein, 194 aa, Zea mays
MVEVEEEQRNPFQECLMAGGKEAHGWAARDVSGHLSPYHFSRRVQRDDDVTIKVLFCGLCHTDLHVIKNEFGNAKYPVVPGHEIVGVVTDVGSGVTSFKPGDTVGVGYFVDSCRSCDSCSKGYESYCPQLRGDVQRREPGRTMTAAPPPRAASPTPSSSTSATWCGSRPACRPPGPRRCCAPASPCSAPWCSTA

SEQ ID NO: 287 - DNA, 477 bp, Zea mays
  CDS (30)..(30): n means a or g or c or t/u
  CDS (372)..(372): n means a or g or c or t/u
  CDS (429)..(429): n means a or g or c or t/u
atggggttcgtcggagacacgatggagtanatccgctccatgcagatccgccaagtgctcatgcagatcatcagcctcggtatgattgttacctctgcattaatcatatggaagggtttgatagttttcacggggagcgagtcaccagttgtagtggtgctctcgggtagcatggagcctggatttaaaaggggtgatatcctgtttttgcacatgagcaaagatcctattcgcacaggagaaatagttgttttcaatatcgatggtcgtgagattccaattgtccaccgagtgattaaggtccatgaacgtcaggacactgcagaagtggacatcctcaccaaaggtgacaataattttggggatgaccanctattatatgcacatggccagctttggctccagcaacaccacattatggggcgtgcnggtgggctaccttccatatgttggctgggttacaattatcatgactga

SEQ ID NO: 288 - protein, 158 aa, Zea mays
  misc_feature (10)..(10): Xaa can be any amino acid
  misc_feature (124)..(124): Xaa can be Gln or His
MGFVGDTMEXIRSMQIRQVLMQIISLGMIVTSALIIWKGLIVFTGSESPVVVVLSGSMEPGFKRGDILFLHMSKDPIRTGEIVVFNIDGREIPIVHRVIKVHERQDTAEVDILTKGDNNFGDDXLLYAHGQLWLQQHHIMGRAGGLPSICWLGYNYHD

SEQ ID NO: 289 - DNA, 783 bp, Zea mays
  CDS (1)..(783)
atggctgtcggaaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttggggcatgaattttaccactgataaactcagatccctagtgaagaagtggcagacattaatcgaagcccatgttgatgtcaagacaaccgacaactacatgttgcgtttgttctgcatcggcttcaccaagaggcgcccaaaccaggtcaagagaacctgctatgctcaggcatcccagatccgtcagatccgccgtaagatggttgagattatgatcaaccaggcttctacatgtgacctgaaagaacttgtttcgaagttcattccagaagttattggtaaggagattgagaagtctacctccagcatcttcccacttcaaaacgtcttcatccgcaaggtgaagatactcaaggcccccaagttcgatcttgggaagctcatggaggttcatggcgactacaaagaggatgttggtgtgaagcttgagaggcctgtcgagggagatgaggctgggcaggaggttgctgctgccgagtga

SEQ ID NO: 290 - protein, 260 aa, Zea mays
MAVGKNKRISKGKKGGKKKTVDPFSKKDWYDIKAPSVFSVRNIGKTLVSRTQGTRIASEGLKHRVFEVCLADLQGDEDQAYRKIRLRAEDVQGRNVLTNFWGMNFTTDKLRSLVKKWQTLIEAHVDVKTTDNYMLRLFCIGFTKRRPNQVKRTCYAQASQIRQIRRKMVEIMINQASTCDLKELVSKFIPEVIGKEIEKSTSSIFPLQNVFIRKVKILKAPKFDLGKLMEVHGDYKEDVGVKLERPVEGDEAGQEVAAAE

SEQ ID NO: 291 - DNA, 618 bp, Zea mays
  CDS (1)..(618)
atgcgagagggagggcggaagaggatgagcgcgtccaggttcataaagtgcgtcacggtcggggacggcgccgtcggcaagacctgcatgctcatctcctacacctccaacaccttccccaccgactatgttccgacagtgtttgataacttcagtgccaacgttgtggttgatggtaatactgtcaacctcggcctctgggacactgcaggtcaagaggattacaacagactgagaccactgagctatcgtggagctgatgtttttcttctggctttctcactgatcagtaaggccagctatgagaatgtttcgaagaagtggatacctgaactgaagcattatgcacctggtgtgccaattattctcgtagggacaaagcttgatcttcgagacgacaagcagttctttgtggaccatcctggtgctgtccctatcactactgctcagggagaggagctaagaaagcaaataggcgctccatactacatcgaatgcagctcgaagacccaactaaacgtgaagggcgtcttcgatgcggcgataaaggttgtgctgcagccgcctaaggcgaagaagaagaaaaaggtgcagaggggggcgtgctccattttgtga

SEQ ID NO: 292 - protein, 205 aa, Zea mays
MREGGRKRMSASRFIKCVTVGDGAVGKTCMLISYTSNTFPTDYVPTVFDNFSANVVVDGNTVNLGLWDTAGQEDYNRLRPLSYRGADVFLLAFSLISKASYENVSKKWIPELKHYAPGVPIILVGTKLDLRDDKQFFVDHPGAVPITTAQGEELRKQIGAPYYIECSSKTQLNVKGVFDAAIKVVLQPPKAKKKKKVQRGACSIL

SEQ ID NO: 293 - DNA, 666 bp, Zea mays
  CDS (1)..(666)
atggggactaccatcgtcggggtctgctacgagggcggcgtcgtcctgggcgccgattccaggaccagcactggaatgtatgtagccaaccgtgcttcagacaagattactcaactgacagacaatgtgtatgtctgtcgctctggatctgctgctgatacacaagtcatttcggattatgtacgctatttcctccaccaacacacaatccagcttggacaaccagctaccgttaaagttgcagccaacttgattaggttgctagcttatcagaacaagaacatgttgcaagctggcatgattgttggaggatgggacaagtacgagggaggccaaattttctcagtccctctcggtggaacgatcttgaagcaaccatttgcaattggaggttcaggttccagttacctatatgctcttcttgatcatgaatggaaagagggaatgagtcaggaagaggcagagaaatttgtggtgaaggtagtttcccttgctatggcccgtgatggtgctagtggaggggttgtccgtacagttccaataaatgcggatggcgtgaagaggaacttttcccctggcgccaagctacccctgtggcccgacgagctgaaaccccaaaactcgttgcttgatattcttgctgctgggaaccctgatcccatgtga

SEQ ID NO: 294 - protein, 221 aa, Zea mays
MGTTIVGVCYEGGVVLGADSRTSTGMYVANRASDKITQLTDNVYVCRSGSAADTQVISDYVRYFLHQHTIQLGQPATVKVAANLIRLLAYQNKNMLQAGMIVGGWDKYEGGQIFSVPLGGTILKQPFAIGGSGSSYLYALLDHEWKEGMSQEEAEKFVVKVVSLAMARDGASGGVVRTVPINADGVKRNFSPGAKLPLWPDELKPQNSLLDILAAGNPDPM

SEQ ID NO: 295 - DNA, 597 bp, Zea mays
  CDS (1)..(597)
atgaatcccgagtacgactaccttttcaaacttctgcttattggtgattctggtgttgggaaatcatgcttgcttctcagatttgcagacgattcttatttggacagctatatcagcacaattggggttgatttcaaaattcgcacagtggagcaagatgggaagactataaaacttcaaatttgggatactgctgggcaagagcgcttcaggacaatcactagcagctactaccgcggagctcatggaatcattattgtatatgacgtgacagaccaagaaagcttcaataatgtgaagcaatggttgaacgagatagaccgttatgcaagtgataatgttaacaagctccttgttgggaacaagagtgaccttactgccaacaaagttgtggcaactgagacagcaaaggcgtttgctgatgagatgggcatcccattcatggagacgagtgccaaaaacgccatcaacgtggagcaggccttcatggctatggctgcatccatcaaggataggatggccagccaaccagccgcggccaacgctaggccagcgaccgtgcagatccgcgggcaacccgtcaaccagaagacgtga

SEQ ID NO: 296 - protein, 198 aa, Zea mays
MNPEYDYLFKLLLIGDSGVGKSCLLLRFADDSYLDSYISTIGVDFKIRTVEQDGKTIKLQIWDTAGQERFRTITSSYYRGAHGIIIVYDVTDQESFNNVKQWLNEIDRYASDNVNKLLVGNKSDLTANKVVATETAKAFADEMGIPFMETSAKNAINVEQAFMAMAASIKDRMASQPAAANARPATVQIRGQPVNQKT

SEQ ID NO: 297 - DNA, 1485 bp, Zea mays
  CDS (1)..(1485)
atgtcaccaccactcttggcgagcgaaatccaccgtacaccgctgcctccctctccctgtctcgtctcgtcgaaccagccgaggaagccaacgcagacccagcgatcctcgtcgcgcgccctcctcccccacggagggaaggatggcggacgcaaagcggcggcggcggcgaggaagacgcgggtgggcccgtacgaggtcggcaagaccatcggcgagggcagcttcgccaaggtcaagcacgcgcgcgactcccgcaccggcgccgtccgcgccatcaaggtgctcgaccgcaaccacgtcctccgccacaggatggtcgagcagatcaagcgggagatttcgactatgaagctgatcaaacatcccaatgtggtccagctgcatgaggttatggcgagcagaacgaagatatacatggttcttgaatttgttgatggaggcgagctattcgataagatcgtcaattctggaaggctaggagaggatgaagctaggatatactttcatcaacttataaatgcggttgattattgtcatagccgaggagtgtaccatagagatctgaagccagagaatctacttctggactcacatggaacccttaaagtttcagactttggcctaagtgcatttgcaccacaaacaaaagaggatgggcttctgcatactgcctgtggaactccaaactatgtagcgcctgaggtgctcgctgataaaggctatgatggtatggctgcagatgtatggtcctgtggcataatcttgtttgttcttatggccggatacttaccctttgatgatgtcaatctgatgagactgtacaaactgatctgccatgcaactttttcttgcccaccatggttttcttctggagcaaggaagtttattaagcgcattctcgatcctaaccctgatactaggataaaaattgcagaaatgttggaagatgaatggttcaaaaaaggctataaaccaccacattttgaacaaggcgaagatgttaaccttgacgacattgatgctgcattcaatgattcagaggaccgtcttgtggcagagaaaagagagaagccagaatccatgaacgcatttgctcttatttcgaggtcgcagggtttcaaccttggaaatttgtttgagaaggagatgatgggaatggtaaagagggaaacatctttcacgtctcaatgtacagcacaggagatcatgtcaaaaatagaggatgcatgtgggccactcggtttcaacgtgcggaaacaaaattacaagatgaaattgaaaggtgacaaatctggaagaaaaggtcacttatctgttgcaactgaggtttttgaggttgccccatcacttcacatggttgagcttcgtaaaaccggaggagacacattggagttccacagcttctacaagaacttctcatcggagctgaaagatatcgtgtggaaagctgaatctgatgcaaataataaacagacgaagtga

SEQ ID NO: 298 - protein, 494 aa, Zea mays
MSPPLLASEIHRTPLPPSPCLVSSNQPRKPTQTQRSSSRALLPHGGKDGGRKAAAAARKTRVGPYEVGKTIGEGSFAKVKHARDSRTGAVRAIKVLDRNHVLRHRMVEQIKREISTMKLIKHPNVVQLHEVMASRTKIYMVLEFVDGGELFDKIVNSGRLGEDEARIYFHQLINAVDYCHSRGVYHRDLKPENLLLDSHGTLKVSDFGLSAFAPQTKEDGLLHTACGTPNYVAPEVLADKGYDGMAADVWSCGIILFVLMAGYLPFDDVNLMRLYKLICHATFSCPPWFSSGARKFIKRILDPNPDTRIKIAEMLEDEWFKKGYKPPHFEQGEDVNLDDIDAAFNDSEDRLVAEKREKPESMNAFALISRSQGFNLGNLFEKEMMGMVKRETSFTSQCTAQEIMSKIEDACGPLGFNVRKQNYKMKLKGDKSGRKGHLSVATEVFEVAPSLHMVELRKTGGDTLEFHSFYKNFSSELKDIVWKAESDANNKQTK

SEQ ID NO: 299 - DNA, 546 bp, Zea mays
  CDS (477)..(477): n means a or g or c or t/u
atgcttggccatcatgaccttgacgaactcctcgtagttgatctggccgtcgccgtcaacatcggcctcacggatcatctcgtcgacctcctcgtcagtcagcttctcgccgaggttggtcatgacatggcggagctcagcagccgagatgaaaccattctggtccttgtcgaagacgcgaaaggcctccttaagctcctcctcggagtcggtgtccttcatcttccttgccatcaggttcaggaactctgggaagtcaatggtcccattgccatcagcatcaacctcgttgatcatgtcctgcagctctgcttcagtggggttctggccaagggagcgcatcacagttccaagctccttggtagtgatgcagccgtcgccatccttatcgaagaggctgaaggcctccttgaactccgcgatctgctcgtccgtgagctggtccgccatggaagatggctgcggcgagggcacgcngatggggaagaaggggaaacgatggatgctcgtgctcgcgtcactttgttgattggtctgaccggatga

SEQ ID NO: 300 - protein, 181 aa, Zea mays
MLGHHDLDELLVVDLAVAVNIGLTDHLVDLLVSQLLAEVGHDMAELSSRDETILVLVEDAKGLLKLLLGVGVLHLPCHQVQELWEVNGPIAISINLVDHVLQLCFSGVLAKGAHHSSKLLGSDAAVAILIEEAEGLLELRDLLVRELVRHGRWLRRGHADGEEGETMDARARVTLLIGLTG

SEQ ID NO: 301 - DNA, 777 bp, Zea mays
  CDS (1)..(777)
atgtcgaacatggctgtcggcaaaaacaaaggtctctcaaagggaggcaaaaaaggctccaagaagaaggtcgtcgatccattctcacgcaaagattggtatgatattaaagcgccaagcatgtttgctaaccgacaagtcggaaagactttggtaaatcgtacacaaggtacaaaaatcgcatcggaaggcttgaagcatcgtgtgttcgaggtgtcgctagccgatttacaaaatgatcaagatgctgaaagatcgttccggaaattccgtttgattgcggaagatgtgcaaggaactcacgttttgaccaacttccatggcatggatttaacgacagacaaattgcgttcgatggtcaagaaatggcaaacactcatcgaagctaacatcgatgtcaagacaaccgatggctatttgctccgcgttttctgcattggattcaccgccaaggaccagatgtctcagcgtaaaacatgctacgcccaacattcacatgtccgttccattcgcaagaagatgtgcgaaattatcacacgcgacattaccggatccgatttgaaggaggtcgtcaacaaattgctgcccgattccattgccaaggacattgaaaagtcatgcttgggcatctgtccgttgcacgatgtgtacattcgcaaagtgaaagtgttgaagaagccacgtttcgatttggccaaattgttggaactccacggtgatggcggcggtaaagctgctgatggcgttgtctcggccgaaggtgttgtcgtcgaatga

SEQ ID NO: 302 - protein, 258 aa, Zea mays
MSNMAVGKNKGLSKGGKKGSKKKVVDPFSRKDWYDIKAPSMFANRQVGKTLVNRTQGTKIASEGLKHRVFEVSLADLQNDQDAERSFRKFRLIAEDVQGTHVLTNFHGMDLTTDKLRSMVKKWQTLIEANIDVKTTDGYLLRVFCIGFTAKDQMSQRKTCYAQHSHVRSIRKKMCEIITRDITGSDLKEVVNKLLPDSIAKDIEKSCLGICPLHDVYIRKVKVLKKPRFDLAKLLELHGDGGGKAADGVVSAEGVVVE

SEQ ID NO: 303 - DNA, 540 bp, Zea mays
  CDS (1)..(540)
atgatgtttcaccacaaatttatgacatcacgacagggcacagttctttctggagtttgttcccagcttcaaatcctacgcatatcaccaccacccgcttgcccgcgatctgaatcagtccacaagtgtgcccaaaatgtcatcctctctgaagaggaggtactctttatcagccgcaagcttgacttcagatccaccatactcgggcagaagaacagtgtcgccttccttcagagcaactgggatcagattgcctgccttgtcgcgctcaccagggccaacagccaccactttagcagcattcagctgcttggatgtttccgggaggaggatgccgccggcggtcttcttgggctgcaccagcttctccaccagcacccggttcagcgacgggagcagcctcttcgccatcgccgccctcctctcgtttcccttcttcttgcgcagcaagacaaagaagaaaaaagctcgacgcttccacagttccactcgcggctcgcctcaccgataaacctgggtcctgggtttagggttttatga

SEQ ID NO: 304 - protein, 179 aa, Zea mays
MMFHHKFMTSRQGTVLSGVCSQLQILRISPPPACPRSESVHKCAQNVILSEEEVLFISRKLDFRSTILGQKNSVAFLQSNWDQIACLVALTRANSHHFSSIQLLGCFREEDAAGGLLGLHQLLHQHPVQRREQPLRHRRPPLVSLLLAQQDKEEKSSTLPQFHSRLASPINLGPGFRVL

SEQ ID NO: 305 - DNA, 495 bp, Zea mays
  CDS (1)..(495)
atgccggcggggcacgggctgcggtcgcggacccgcgacctgttcgcgcggcccttccgcaagaaggggtacatcccactcaccacgtacctgcgcacctacaagatcggcgactacgtcgacgtcaaggttaacggcgccgtgcacaagggcatgccgcacaagttctaccacggccgcaccgggagcgtctggaacgtcaccaagcgcgccatcggcgtcgagatcaacaagcaggttaatggccgcatcatcaggaagcggatccatgtccgcgtggagcatgtgcagccctcccgttgcacggaggagttccgcttgaggaaagccaagaatgaccagctcaaggcggatgccaaggcccgcggtgaggtgatcagcaccaagaggcagcctgtgggacccaaacctggcttcatggttgagggtgctacactcgagacagtcactcctattccttatgatgtggtcaacgatctcaagggcggttactga

SEQ ID NO: 306 - protein, 164 aa, Zea mays
MPAGHGLRSRTRDLFARPFRKKGYIPLTTYLRTYKIGDYVDVKVNGAVHKGMPHKFYHGRTGSVWNVTKRAIGVEINKQVNGRIIRKRIHVRVEHVQPSRCTEEFRLRKAKNDQLKADAKARGEVISTKRQPVGPKPGFMVEGATLETVTPIPYDVVNDLKGGY

SEQ ID NO: 307 - DNA, 1452 bp, Zea mays
  CDS (1)..(1452)
atggcacgagggagcagctcccctgcccctcgcagcggctactctacaggtctagcgactctttcgccatccatagagggaggaggcgcggcggagatggtgggcggtggcggcggcgggccgctgcggcgggtgggcaagtacgaggtgggacgcaccatcggggaaggcaccttcgccaaggtcaagttcgcgcagaacaccgagaccggggagagcgtcgccatgaaggtgctcgaccgctcctccatcctcaagaacaagatggccgaacagattaagagagaaatatccataatgaagcttgtcaggcatcccaatgtcgttaggctacacgaggttttggcaagccggaagaagatatttataattctggagttcatcactggcggcgagctattcgataaaattattcgtcatgggagactcagtgaagcagatgcccgcagatactttcagcagcttattgatggtgttgatttttgtcacaagaaaggagtctaccatcgagacttaaagcctgaaaatctcctccttgattcccaaggcaatcttaaaatttcagactttggactgagtgcatggcctgctcagggatctttccttctacgtacaacctgtgggactccgaactatgttgccccagaggttctcagtcataagggatataatggcgcacttgctgatacatggtcatgtggagtaattttatatgtattgttagcaggttatcttccatttgatgaagtggacctgactaccctttatggaaagattgagagtgcagaatattcattcccagcctggttttcaggtggtgcaaaatcactgattcgtagaattcttgacccaaatccagagacacgaatcaggatagaagagatcagaagcgatgaatggtttcagaaaaattatgaacctatcaaagaaatagaaaatgaggaagtcaatctcgatgatgtcaatgcagcttttgatgatcctgaggacgataatgaggatgctttcgaagatgaaacaggtcctctaacacttaatgcattcgacctaatcattctttcgcaaggattgaatcttgcagcgctctttgaccgcagacaggactgtgacaagcttcaaaatagattcttatcacgcaatccagcaaaggttatcttgtcaagcatggaggttgttgcgcaatcaatgggatttaagacacacattcgcaattataagatgagggtggaaggtctaaatgccgacaagactagtcatctctcagttatggttgaagttttcgaagttgctccatcaatcttcatggtagaactacaaagagcagcaggagatacttcagagtataacacgttcgtaaataactactgcggcaaattagatgatatcatctggaaatttccaactgagaagggaaaatcaaggataccccggttatcaaagtctcattcatga

SEQ ID NO: 308 - protein, 483 aa, Zea mays
MARGSSSPAPRSGYSTGLATLSPSIEGGGAAEMVGGGGGGPLRRVGKYEVGRTIGEGTFAKVKFAQNTETGESVAMKVLDRSSILKNKMAEQIKREISIMKLVRHPNVVRLHEVLASRKKIFIILEFITGGELFDKIIRHGRLSEADARRYFQQLIDGVDFCHKKGVYHRDLKPENLLLDSQGNLKISDFGLSAWPAQGSFLLRTTCGTPNYVAPEVLSHKGYNGALADTWSCGVILYVLLAGYLPFDEVDLTTLYGKIESAEYSFPAWFSGGAKSLIRRILDPNPETRIRIEEIRSDEWFQKNYEPIKEIENEEVNLDDVNAAFDDPEDDNEDAFEDETGPLTLNAFDLIILSQGLNLAALFDRRQDCDKLQNRFLSRNPAKVILSSMEVVAQSMGFKTHIRNYKMRVEGLNADKTSHLSVMVEVFEVAPSIFMVELQRAAGDTSEYNTFVNNYCGKLDDIIWKFPTEKGKSRIPRLSKSHS

SEQ ID NO: 309 - DNA, 1479 bp, Zea mays
  CDS (1)..(1479)
atgggcacagcgcagagacaggcgtcttcgtactcgcctatctccgcgactcaaagctttccccaattcccccccttctcccatttctcaccaccgccgccgctccccccgttcaacaacaccatgagggagtgcatctcgatccacatcggccaggctggtatccaggtcggaaacgcgtgctgggagctgtactgcctcgagcatggcattcaggctgatggccagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctaccgccagctcttccatcctgagcagctcatcagtggcaaggaggatgcagccaacaacttcgctcgtggtcactacaccattggcaaggagattgttgacctgtgccttgaccgcatcaggaagcttgcagataattgcactggtctccagggcttcctcgtcttcaacgctgttggtggaggaacgggctctgggcttggttctctcctcctggagcgcctgtctgttgactatggcaagaagtccaagctcggtttcaccgtgtacccatccccccaggtgtccacatccgtggttgagccatacaacagtgtcctgtccacccactctctcctcgagcacactgatgttgctgtcctgctcgacaatgaggccatctatgacatctgccgccgctcccttgacattgagcgcccaacctacaccaacctcaacaggcttgtctcccaggtcatctcatccctgacggcttccctgaggttcgatggtgctctgaacgttgatgtgaacgagttccagaccaacctggtgccctacccgaggatccacttcatgctttcgtcctacgctccagtcatttctgctgagaaggcctaccacgagcagctgtccgtggctgaaatcaccaacagcgccttcgagccatcctccatgatggccaagtgcgacccccgccatggcaagtacatggcatgctgcctcatgtaccgtggtgatgtggttcccaaggacgtgaacgctgctgtggccacaatcaagaccaagcgcaccatccagttcgtggactggtgcccgactggcttcaagtgcggaatcaactaccagcctcccagcgtcgtcccaggcggtgatctggccaaggtgcagcgtgccgtgtgtatgatctccaactccaccagtgttgtggaggtcttctcccgcattgaccacaagttcgacctcatgtacgccaagcgcgccttcgtgcactggtacgtcggtgagggtatggaggagggcgagttctccgaggctcgtgaggatctggcggcgcttgagaaggactacgaggaggtcggtgctgagtttgacgagggtgaggacggcgacgagggtgacgagtactga

SEQ ID NO: 310 - protein, 492 aa, Zea mays
MGTAQRQASSYSPISATQSFPQFPPFSHFSPPPPLPPFNNTMRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVAVLLDNEAIYDICRRSLDIERPTYTNLNRLVSQVISSLTASLRFDGALNVDVNEFQTNLVPYPRIHFMLSSYAPVISAEKAYHEQLSVAEITNSAFEPSSMMAKCDPRHGKYMACCLMYRGDVVPKDVNAAVATIKTKRTIQFVDWCPTGFKCGINYQPPSVVPGGDLAKVQRAVCMISNSTSVVEVFSRIDHKFDLMYAKRAFVHWYVGEGMEEGEFSEAREDLAALEKDYEEVGAEFDEGEDGDEGDEY

SEQ ID NO: 311 - DNA, 492 bp, Zea mays
  CDS (4)..(4): n means a or g or c or t/u
  CDS (5)..(5): n means a or g or c or t/u
atgnngctccgatcgacctgctccctccccaccaccgagcccatggcggaccagctcaccgacgaccagatcgccgagttcaaggaggccttcagcctcttcgacaaggacggggatggttgcatcacgaccaaggagctgggcactgtcatgcgctcgctggggcaaaatcctacagaggctgagctccaggacatgatcaacgaggtcgatgctgatggcaacggcaccatcgatttcccagagtttctcaaccttatggctcgcaagatgaaggacaccgactctgaggaagagctcaaggaggccttccgtgtgtttgacaaggaccagaacggcttcatctcggccgccgagctccgccatgtcatgacaaatcttggtgagaagctaactgatgaggaggtggacgagatgatccgtgaggctgatgtcgatggtgatggccagatcaactacgaggagtttgtcaagctcatgatggccaagtga

SEQ ID NO: 312 - protein, 163 aa, Zea mays
  misc_feature (2)..(2): Xaa can be any amino acid
MXLRSTCSLPTTEPMADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKLMMAK

SEQ ID NO: 313 - DNA, 474 bp, Zea mays
  CDS (4)..(4): n means a or g or c or t/u
atgnttcgctgtcgacgatttcgtatggcggaccagctcaccgacgaacagatcgccgagttcaaggaggccttcagcctcttcgacaaggacggcgacggctgcatcaccaccaaggaacttggcactgtgatgcgctcattggggcagaaccctactgaggctgagcttcaggacatgatcaatgaggttgatgctgatggcaatggaaccatcgactttcctgagtttctcaacctgatggcacgcaagatgaaggacaccgactctgaggaggagctcaaggaggccttccgtgtgttcgacaaggaccagaacggcttcatctccgctgctgagcttcgccatgtcatgaccaacctaggcgagaagctgacggacgaggaggtggacgagatgatccgtgaagccgacgtggacggtgatggccagatcaactacgacgagttcgtgaaggtgatgatggccaagtga

SEQ ID NO: 314 - protein, 157 aa, Zea mays
  misc_feature (2)..(2): Xaa can be Ile or Leu or Val or Phe
MXRCRRFRMADQLTDEQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYDEFVKVMMAK

SEQ ID NO: 315 - DNA, 777 bp, Zea mays
  CDS (104)..(104): n means a or g or c or t/u
atggggtaccggaagcggcgaaagcctcgccccccgccgctctcgcatcgtctccggagcgcacgtcagatcaggtgtgccgcgcccccctcgcctaagctgcngacgaccatccatcgaacaggaaggatgacgggctccatggatctcccggccaagggcgggttcagcttcgacctgtgccgccggaacaacatgctggagaagaacggactcaaggtcccgggattcaggaagaccgggacaaccatcgtcggcctcgtctttcaggatggggttgttcttggggcagacacaagggcaactgagggccccatagttgctgataagaactgtgagaaaatccactttatggcaccgaatatatactgctgtggagcaggaactgctgcggacacggaggccgttacagatatggtgagctcccagctacagcttcaccgttatgcaacgggccgcgaatcaagagttgtaactgctcttacactactgaagtcacacctcttcaagtatcaaggccatgtcagtgctgcccttgttcttggtggagtggattgtactgggccacatttacacactgtttatccacacgggtccactgatactcttccttttgccaccatgggctctggttctcttgctgcaatgtcagtgtttgaatcgaagtacaaagaaggccttactagggaggagggaatacagattgtgtgcgaagcaatctgtgctggtattttcaatgacttgggtagtgggagcaacgtggacgtctgcgtgtga

SEQ ID NO: 316 - protein, 258 aa, Zea mays
  misc_feature (35)..(35): Xaa can be Arg or Gln or Leu or Pro
MGYRKRRKPRPPPLSHRLRSARQIRCAAPPSPKLXTTIHRTGRMTGSMDLPAKGGFSFDLCRRNNMLEKNGLKVPGFRKTGTTIVGLVFQDGVVLGADTRATEGPIVADKNCEKIHFMAPNIYCCGAGTAADTEAVTDMVSSQLQLHRYATGRESRVVTALTLLKSHLFKYQGHVSAALVLGGVDCTGPHLHTVYPHGSTDTLPFATMGSGSLAAMSVFESKYKEGLTREEGIQIVCEAICAGIFNDLGSGSNVDVCV

SEQ ID NO: 317 - DNA, 1350 bp, Zea mays
  CDS (1)..(1350)
atgtatcgggctaagagggctgcattgtcaccgaaggtgaagcgccgcgtcggcaagtacgagctcgggcgcaccattggggaagggaccttcgccaaggtccggtttgcgaagaacaccgaaaacggggaacctgttgctatcaaaatccttgacaaggagaaggttaagaggcacagattggttgagcagattaagcgtgaaatttgtatcatgaaattagtaaggcaccctaatgttgttcgactgtttgaggtgatgggaagtaaagcaagaattttcatcgttctggaatatgttaccggcggagagctttttgaaatcattgctactaatggaaggttgaaggaagacgaagcacgtaaatacttccagcaactgattaatgctgttgattactgccacagtaggggagtgtatcacagagacttgaagctcgagaatttgctgcttgatgctgcaggaaatctcaaagtttctgactttggtttaagtgctttaaccgagcaagtgaaggctgatggtctgcttcatacaacatgtggaacccccaattatgttgcccctgaggtgatcgaggatggaggctatgatggtgcaactgcagatatttggtcttgcggagtaatcctctttgttcttcttgctggatatttacctttcgaggatgacaacatcatcgccctatacaagaagatttcagaagctcagtttagctgcccctcttggttttcagctggggccaagaacatgattaccagaattcttgatcccaatcctacaactagaatcacgatttctcagatactggagcatccttggttcaaaaaggggtacaagcctcctgtttttgacgagaaatatcaaactagcttggatgacgtggatgctgcttttggagattcagaagaccggcatgtgaaagaggaaactgaagatcagccaacctcaatgaatgcattcgaactgatttcactaaaccaggcactgaatctggagaatttgtttgaagcaaaggaggagtataaaagagagacaagattcacctcacagtgccccccgaaagagataatcacaaagatcgaagaagctgcaaagccgcttggctttgatgttcaaaagaaaaaatacaagatgcggatggagaacccgaaagcaggtagaaagggcaatctgaatgttgcaactgaggtcttccaaatagccccatccctgcatgtagtcgagctcaagaaggcgaagggggacactctggagttccaaaagttctacagaagcctgtcgacccagctgaaggatgttgtgtggaagtgcgacggcgaggtggacggcaacagcgcggcagcatga

SEQ ID NO: 318 - protein, 449 aa, Zea mays
MYRAKRAALSPKVKRRVGKYELGRTIGEGTFAKVRFAKNTENGEPVAIKILDKEKVKRHRLVEQIKREICIMKLVRHPNVVRLFEVMGSKARIFIVLEYVTGGELFEIIATNGRLKEDEARKYFQQLINAVDYCHSRGVYHRDLKLENLLLDAAGNLKVSDFGLSALTEQVKADGLLHTTCGTPNYVAPEVIEDGGYDGATADIWSCGVILFVLLAGYLPFEDDNIIALYKKISEAQFSCPSWFSAGAKNMITRILDPNPTTRITISQILEHPWFKKGYKPPVFDEKYQTSLDDVDAAFGDSEDRHVKEETEDQPTSMNAFELISLNQALNLENLFEAKEEYKRETRFTSQCPPKEIITKIEEAAKPLGFDVQKKKYKMRMENPKAGRKGNLNVATEVFQIAPSLHVVELKKAKGDTLEFQKFYRSLSTQLKDVVWKCDGEVDGNSAAA

SEQ ID NO: 319 - DNA, 792 bp, Zea mays
  CDS (1)..(792)
atggggttcagcttcgacctgtgccgccggaacaacatgctggagaagaacggactcaaggtcccgggattcaggaagaccgggacaaccatcgtcggcctcgtctttcaggatggggttgttcttggggcagacacaagggcaactgagggccccatagttgctgataagaactgtgagaaaatccactttatggcaccgaatatatactgctgtggagcaggaactgctgcggacacggaggccgttacagatatggtgagctcccagctacagcttcaccgttatgcaacgggccgcgaatcaagagttgtaactgctcttacactactgaagtcacacctcttcaagtatcaaggccatgtcagtgctgcccttgttcttggtggagtggattgtactgggccacatttacacactgtttatccacacgggtccactgatactcttccttttgccaccatgggctctggttctcttgctgcaatgtcagtgtttgaatcgaagtacaaagaaggccttactagggaggagggaatacagattgtgtgcgaagcaatctgtgctggtattttcaatgacttgggtagtgggagcaacgtggacgtctgcgtgataaccaaggggaagacagaatacttgagaaaccaccagttgccgaatcccaggacttatgctagttcaaagggatacagtttcaccaaggggcagactgaggtactgtcttcaaaggtcacacttctaaagcagaaggttgaggtcgccgagggtggtgatgctatggaggagtga

SEQ ID NO: 320 - protein, 263 aa, Zea mays
MGFSFDLCRRNNMLEKNGLKVPGFRKTGTTIVGLVFQDGVVLGADTRATEGPIVADKNCEKIHFMAPNIYCCGAGTAADTEAVTDMVSSQLQLHRYATGRESRVVTALTLLKSHLFKYQGHVSAALVLGGVDCTGPHLHTVYPHGSTDTLPFATMGSGSLAAMSVFESKYKEGLTREEGIQIVCEAICAGIFNDLGSGSNVDVCVITKGKTEYLRNHQLPNPRTYASSKGYSFTKGQTEVLSSKVTLLKQKVEVAEGGDAMEE

SEQ ID NO: 321 - DNA, 519 bp, Zea mays
  CDS (1)..(519): n means a or g or c or t/u
atgnngagagaccgacagaagacaacccgtcagcccctctcgtttttcatccgccttcgcctccaccgcgtgcgctccacgcctcctccaggaaagcgagagcttctgcataagaacaacaaatcaaaagcngtgatcagctcggtgccaacaaaacctcaacaaccaagtttcatgtctgatctcgacgtccagcttccatctgcctttgatccgtttgctgaggcaaatgctgaggactctggtgctggtcctggaacgaaggattatgtgcatgtgcgcatccagcagcgcaacggcagaaagagtctgactacagtccagggtctgaagaaagagttcagctataacaagatcctcaaggatctgaagaaggaattctgctgcaatggtactgtagttcaggacccagagctaggccaggtcattcagctccaaggtgatcagcgcaagaatgttgctactttcctagttcaggctgggattgcgaagaaagagaacatcaagattcacgggtga

SEQ ID NO: 322 - protein, 172 aa, Zea mays
  misc_feature (2)..(2): Xaa can be any amino acid
MXRDRQKTTRQPLSFFIRLRLHRVRSTPPPGKRELLHKNNKSKAVISSVPTKPQQPSFMSDLDVQLPSAFDPFAEANAEDSGAGPGTKDYVHVRIQQRNGRKSLTTVQGLKKEFSYNKILKDLKKEFCCNGTVVQDPELGQVIQLQGDQRKNVATFLVQAGIAKKENIKIHG

SEQ ID NO: 323 - DNA, 762 bp, Zea mays
  CDS (1)..(762)
atgttcgctgtcgacgatttcgtggttttgctgctctccgaccccgagctccgaaggccgcagcatcaggcgcggcccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaagcttacttacaagaatgttcctacgtggcatagggacctgtgcagggtctgtgaaaacatccccattgtcctctgcggtaataaggttgatgtgaagaacaggcaggtcaaagccaagcaggttactttccacaggaagaagaatctgcagtactatgaaatttctgccaagagcaactacaactttgagaaacctttcctgtaccttgcaaggaagctggctggtgatccgaaccttcactttgttgaagctgttgctcttaagcctccggaagttaccatcgacatggctatgcagcagcagcatgaagctgagcttgctgcagcagctgcacaacctcttcctgatgacgatgatgatctgattgagtga

SEQ ID NO: 324 - protein, 253 aa, Zea mays
MFAVDDFVVLLLSDPELRRPQHQARPPSRVTEMALPNQGTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSKLTYKNVPTWHRDLCRVCENIPIVLCGNKVDVKNRQVKAKQVTFHRKKNLQYYEISAKSNYNFEKPFLYLARKLAGDPNLHFVEAVALKPPEVTIDMAMQQQHEAELAAAAAQPLPDDDDDLIE

SEQ ID NO: 325 - DNA, 624 bp, Zea mays
  CDS (1)..(624)
atgatactgatgtgtactcaaaagggacatggcaaagtacagcttgtgtgcctgatatttcacttcaattcattcatagataacggggatcgctcctcacttggccatcatgaccttgacgaactcctcgtagttgatctggccgtcgccgtcaacatcggcctcacggatcatctcgtcgacctcctcgtcagtcagcttctcgccgaggttggtcatgacatggcggagctcagcagccgagatgaaaccattctggtccttgtcgaagacgcgaaaggcctccttaagctcctcctcggagtcggtgtccttcatcttccttgccatcaggttcaggaactctgggaagtcaatggtcccattgccatcagcatcaacctcgttgatcatgtcctgcagctctgcttcagtggggttctggccaagggagcgcatcacagttccaagctccttggtagtgatgcagccgtcgccatccttatcgaagaggctgaaggcctccttgaactccgcgatctgctcgtccgtgagctggtccgccatggaagatggctgcggcgagggcacgcgatggggaagaaggggaaacgatggatgctcgtgctcgcgtcactttgttga

SEQ ID NO: 326 - protein, 207 aa, Zea mays
MILMCTQKGHGKVQLVCLIFHFNSFIDNGDRSSLGHHDLDELLVVDLAVAVNIGLTDHLVDLLVSQLLAEVGHDMAELSSRDETILVLVEDAKGLLKLLLGVGVLHLPCHQVQELWEVNGPIAISINLVDHVLQLCFSGVLAKGAHHSSKLLGSDAAVAILIEEAEGLLELRDLLVRELVRHGRWLRRGHAMGKKGKRWMLVLASLC

SEQ ID NO: 327 - DNA, 963 bp, Zea mays
  CDS (1)..(963)
atgccaccctctgacgatccttctacgccgacgctggtccctccgtgcgacgcggtggagccactgctggcggagtcctccgaccgcttctccatgttcccgatccgcttcccgcagatctgggagttctacaagaaggcggtggcgtccttctggacggccgaggaggttgacctctctgccgacgcccggcactgggacgaggcgctgtcccccgacgagcgccacttcatctctcacgtgctcgccttcttcgccgcctccgacggcatcgtgctcgagaacctcgcgtcccgcttcatgtccgacgtgcaggtcgccgaggcgcgggccttctacggcttccagatcgccatcgagaacatccactcggagatgtactcgctgctgctcgagacctacatccgcgacgacgtcgagaaggaccgcctcttccgcgccatcgatacggtgcccgcggtccggcgcaaggcggactgggccatgcgctggatcgacggcggggagcgcttcgccgagcgcctcgttgccttcgcctgcgtcgagggcatcttcttctcgggctccttctgcgccatcttttggctgaagaagcgcgggctcatgccgggcctcaccttctccaacgagctcatctcccgcgacgagggcctgcactgcgatttcgcctgcctcctctacgatgtcctacgcagcaagctcgacgaggcccgcgtgcgcacgatcgtcgctgacgccgtcgacatcgagcgcgagttcgtctgcgacgccctccctgtctccctcgtcggcatgaacggggacctcatgagccagtacatcgagttcgtggccgaccgcctgctcatggcgctcgggtgcaagaagatgtacaacgtgaccaaccccttcgactggatggagctcatctcgctgcagggaaagaccaacttcttcgagaagcgcgtcggtgactaccagtga

SEQ ID NO: 328 - protein, 320 aa, Zea mays
MPPSDDPSTPTLVPPCDAVEPLLAESSDRFSMFPIRFPQIWEFYKKAVASFWTAEEVDLSADARHWDEALSPDERHFISHVLAFFAASDGIVLENLASRFMSDVQVAEARAFYGFQIAIENIHSEMYSLLLETYIRDDVEKDRLFRAIDTVPAVRRKADWAMRWIDGGERFAERLVAFACVEGIFFSGSFCAIFWLKKRGLMPGLTFSNELISRDEGLHCDFACLLYDVLRSKLDEARVRTIVADAVDIEREFVCDALPVSLVGMNGDLMSQYIEFVADRLLMALGCKKMYNVTNPFDWMELISLQGKTNFFEKRVGDYQ

SEQ ID NO: 329 - DNA, 1362 bp, Zea mays
  CDS (1)..(1362)
atggagaagaagccgaccatcctcatgaacaggtacgagctcgggcgcacgctcgggcagggcaccttcgccaaggtgtaccacggccggaacctcgcgtccggcgagagcgtggccatcaaggtcatcgacaaggagaaggtgatgcgcgtcggcatgatcgaccagatcaagcgcgagatctccgtcatgcgcctcgtccgccaccccaacgtcgtgcagctgcacgaggtgatggccagcaagagcaagatatacttcgccatggagtacgtccggggcggcgagctcttcgcccgcgtcgcccgcggccggctcaaggaggacgccgcgagaaggtacttccaccagctcgtcggcgccgtcgacttctgccacagccgcggcgtctaccaccgcgacctcaagcccgagaacctcctcgtcgacgagcacggcaacctcaaggtctccgacttcggcctcagcgcgctcagggagtgccagaagcaggacggcctgctgcacaccacctgcggcacccccgcgtacgtcgcgccggagatcatcaacaagaagggctacgacggggccaaggccgacatctggtcctgcggcgtcatcctcttcgtgctcctcgccggctacctcccgttccacgacgccaacctggtggagatgtaccgcaagatcagcagagccgacgtcaagtacccgcagtggttctcccctgagctccggcggttgatgcccaagctcctcgaaccgaacccaaacaacaggatcacgatcgagaagctggtcgagcacccctggttcaagaaggggtacaggccggccgtcatgctggcacagccgcacggctccagcagcctcaaggatgtccaggtcgccttcagcaacgccgaccacaaggacagcagcagcaaggtggaacagccggcggacagctccttgaagccggcgagcctgaacgcgttcgacatcatctcccactccagagggttcgacctgtcaagcctgttcgaggtggaccaagagcagaaggccagcaactcgcggttcatgacccagaagccggcgtcggcgatagtgtcaaagctggagcagatcgctgagacagagcgcttcatggtgaaaaaacaggacgggctggtgaagctgcaggggtccaagcaagggaggaaggggcagctcgcgatcgacgccgagatcttcgaggtgacaccggcctttcacgtcgtcgaggtgaagaagtcggcaggcgacacgctggagtatgagatgttctgcagcaagggcctaagaccttcactcagcgacatctgctggagcagccgatctgaggagaacatggctccttcagtggttcagccatcatga

SEQ ID NO: 330 - protein, 453 aa, Zea mays
MEKKPTILMNRYELGRTLGQGTFAKVYHGRNLASGESVAIKVIDKEKVMRVGMIDQIKREISVMRLVRHPNVVQLHEVMASKSKIYFAMEYVRGGELFARVARGRLKEDAARRYFHQLVGAVDFCHSRGVYHRDLKPENLLVDEHGNLKVSDFGLSALRECQKQDGLLHTTCGTPAYVAPEIINKKGYDGAKADIWSCGVILFVLLAGYLPFHDANLVEMYRKISRADVKYPQWFSPELRRLMPKLLEPNPNNRITIEKLVEHPWFKKGYRPAVMLAQPHGSSSLKDVQVAFSNADHKDSSSKVEQPADSSLKPASLNAFDIISHSRGFDLSSLFEVDQEQKASNSRFMTQKPASAIVSKLEQIAETERFMVKKQDGLVKLQGSKQGRKGQLAIDAEIFEVTPAFHVVEVKKSAGDTLEYEMFCSKGLRPSLSDICWSSRSEENMAPSVVQPS

SEQ ID NO: 331 - DNA, 849 bp, Zea mays
  CDS (1)..(849)
atgccttcgttgatcgccgtctcaggtcatggcagggcggcgccggatcgggccgccctgactgtggggccgggcatggacatgccaatcatgcacgacagcgaccggtacgagctcgtgcgcgacatcggctccggcaacttcggcgttgcccgcctcatgcgcgaccgccgcaccagcgaactcgtcgccgtcaagtacatcgagcgcggcgagaagatagatgagaatgtccagcgtgagataattaaccatagatcattgaagcaccctaacattattaggtttaaagaggttattttaacaccgacccatcttgctattgtcatggaatatgcctctggcggtgagctttttgagaggatatgtaagaacgtgcgattcagtgaagatgaggctcgctacttcttccagcagcttatttcaggagtaagctactgccattcaatgcaagtatgccaccgtgatttgaagttggagaacacacttctagatgggagtgatgctcctcgcttgaagatatgtgacttcggttattccaagtcatctgttcttcattcccaaccgaagtcaactgttggaacacctgcttatattgcacctgaagttctgttgaaaaaagaatatgatggcaagattgctgacgtttggtcatgtggtgtaaccctctatgtaatggttgttggcgcatatccttttgaagatccagaagagcctaagaacttccgcaagacaattcagcgtatcttgaatgttcagtacgcaattccagacaacgtgaacatatctccagagtgcaggcatctaatttcgaggatttttttgttggcgatcctgctacgcgaatga

SEQ ID NO: 332 - protein, 282 aa, Zea mays
MPSLIAVSGHGRAAPDRAALTVGPGMDMPIMHDSDRYELVRDIGSGNFGVARLMRDRRTSELVAVKYIERGEKIDENVQREIINHRSLKHPNIIRFKEVILTPTHLAIVMEYASGGELFERICKNVRFSEDEARYFFQQLISGVSYCHSMQVCHRDLKLENTLLDGSDAPRLKICDFGYSKSSVLHSQPKSTVGTPAYIAPEVLLKKEYDGKIADVWSCGVTLYVMVVGAYPFEDPEEPKNFRKTIQRILNVQYAIPDNVNISPECRHLISRIFLLAILLRE

SEQ ID NO: 333 - DNA, 576 bp, Zea mays
  CDS (1)..(576)
atgccgccggaaagccgagggagagggagcgatatggggttcgtcggagacacgatggagtcgatccgctccatgcagatccgccaagtgctcatgcagatcatcagcctcggtatgattgttacctctgcattaatcatatggaagggtttgatagttttcacggggagcgagtcaccagttgtagtggtgctctcgggtagcatggagcctggatttaaaaggggtgatatcctgtttttgcatatgagcaaagatcctattcgcacaggagaaatagttgttttcaatgtcgatggtcgtgagattccaattgtccaccgagtgattaaggtccatgaacgtcaggacactgcagaagtggacatcctcaccaaaggtgacaataattttggggatgaccgactattatatgcacatggccagctttggctccagcaacaccacattatggggcgtgcggtgggctaccttccatatgttggctgggttacaattatcatgactgagaaaccatttattaagtacctgctgattggcgcactgggcttgctggtcataacgtcgaaagattga

SEQ ID NO: 334 - protein, 191 aa, Zea mays
MPPESRGRGSDMGFVGDTMESIRSMQIRQVLMQIISLGMIVTSALIIWKGLIVFTGSESPVVVVLSGSMEPGFKRGDILFLHMSKDPIRTGEIVVFNVDGREIPIVHRVIKVHERQDTAEVDILTKGDNNFGDDRLLYAHGQLWLQQHHIMGRAVGYLPYVGWVTIIMTEKPFIKYLLIGALGLLVITSKD

SEQ ID NO: 335 - DNA, 378 bp, Zea mays
  CDS (1)..(378)
atgcttgccactctcaccaatcaagttttcatgtctgatctcgacattcagatcccaactgccttcgatcccttcgctgaggccaatgctggggactctggtgcggcagcagggtcaaaggactacgtacacgtgcgcatccagcagcgtaatggtcgcaagagcctgaccaccgtccagggattgaagaaggagttcagctacagcaagatcctcaaagatctcaagaaagagttctgctgcaatggtacagtggtccaggacccagaacttggacaggtcattcagctccagggtgatcagaggaagaacgtctcgaatttcctcgtccaggccggcattgtgaagaaggagcacatcaagattcatggtttctga

SEQ ID NO: 336 - protein, 125 aa, Zea mays
MLATLTNQVFMSDLDIQIPTAFDPFAEANAGDSGAAAGSKDYVHVRIQQRNGRKSLTTVQGLKKEFSYSKILKDLKKEFCCNGTVVQDPELGQVIQLQGDQRKNVSNFLVQAGIVKKEHIKIHGF

SEQ ID NO: 337 - DNA, 321 bp, Zea mays
  CDS (1)..(321)
atggccaccttcgagctgtaccggaggtccaccatcggcatgtgcctcaccgagacgctcgacgagatggtctccaacggcaccctcagcccggagctcgctatccaggtcctcgtccagttcgacaagtccatgacggatgctctggagaaccaagtgaagagcaaggttactgtcaagggtcacctgcacacctacaggttctgtgacaatgtgtggaccttcatcttgacagacgcaagcttcaagaacgaggaggccacggagcaggtgggcaaggtgaagattgtggcatgtgattccaaattgctcggacaatga

SEQ ID NO: 338 - protein, 106 aa, Zea mays
MATFELYRRSTIGMCLTETLDEMVSNGTLSPELAIQVLVQFDKSMTDALENQVKSKVTVKGHLHTYRFCDNVWTFILTDASFKNEEATEQVGKVKIVACDSKLLGQ

SEQ ID NO: 339 - DNA, 813 bp, Zea mays
  CDS (1)..(813): n means a or g or c or t/u
atgnagcaccggcgcggcggcggctaccatgggcagtcngggaagaacaagaggatctccaagggaaagaagggtggtaagaaaaagaccgtcgatcccttctctaagaaggactggtatgacatcaaggccccatcggtgttcagtgtgcgcaacattgggaagactctcgtgtccaggacacagggtaccaggattgcctctgatggtctgaagcacagagtctttgaggtttgtctagctgatcttcagggtgacgaggatcaggcttacaggaaaatcaggctccgtgctgaagatgtgcaaggcaggaatgtgctcacaaacttctggggcatgaattttaccaccgataagctcagatctctagtaaagaagtggcagacattgattgaagcccatgttgatgtcaagacaaccgacaactacatgctgcgtttgttctgcattggttttaccaagaggcgcccaaaccaggtcaagagaacctgctatgctcaggcatcccagattcggcagattcgccgcaagatggttgagattatgatcaaccagtcttctacatgtgaccttaaagaacttgtttctaagttcattccggaagttattggcaaagagattgagaagtctacctccagcatcttcccacttcaaaacgtcttcatccgcaaggtgaagatactcaaggcccccaagtttgatctcgggaagttgatggaggttcatggcgactacaaagaggacgttggtgtgaagcttgagaggcctgtcgagggtgatgaggctatgcaggaggttgctgctgccgagtga

SEQ ID NO: 340 - protein, 270 aa, Zea mays
  misc_feature (2)..(2): Xaa can be any amino acid
MXHRRGGGYHGQSGKNKRISKGKKGGKKKTVDPFSKKDWYDIKAPSVFSVRNIGKTLVSRTQGTRIASDGLKHRVFEVCLADLQGDEDQAYRKIRLRAEDVQGRNVLTNFWGMNFTTDKLRSLVKKWQTLIEAHVDVKTTDNYMLRLFCIGFTKRRPNQVKRTCYAQASQIRQIRRKMVEIMINQSSTCDLKELVSKFIPEVIGKEIEKSTSSIFPLQNVFIRKVKILKAPKFDLGKLMEVHGDYKEDVGVKLERPVEGDEAMQEVAAAE

SEQ ID NO: 341 - DNA, 834 bp, Zea mays
  CDS (1)..(834)
atgacgaggcgaccccagcagacaagagacagacgagagagagcgagcaagccgagcatcgtgacctctctctgtttctctctctcttcccttctcgtcttctgcaagaagccagtgaccgtctctgtttctctcattccctttcatcactctgctggtctccctcttccacctctggtcttggccatggcctccagcgcctcccggttcatcaagtgcgtcacagtgggggacggcgccgtgggaaagacctgcatgctcatctgctacaccagcaacaagttccccactgattacatacccactgtcttcgataacttcagtgcaaacgtggtagtcgacggtaccacggtgaatttgggcctttgggatactgcagggcaggaagattacaacagactgaggccactgagctaccgcggagcagatgtgttcgtgctcgccttctcgcttgtcagccgagctagctacgagaatgttatgaagaagtggctaccggagcttcagcattatgcaccgggtgtccccatagtgttggccggaactaaattggatcttcgtgaagacaggcactacttagttgaccatcctggtgcggtacctgttactacagcacagggggaggaactgcgcaagcacattggcgcaacttgctacatcgaatgcagctcaaaaactcagcagaatgtgaaagctgtgtttgatgctgccatcaaggtagtaatcaggcctccgacgaagcagcgagaaaggaagaaaaagaaagaacggcgaggatgctcaatattctgcagccgtatcatgcacgcaagaagactaggatgcttcaagtga

SEQ ID NO: 342 - protein, 277 aa, Zea mays
MTRRPQQTRDRRERASKPSIVTSLCFSLSSLLVFCKKPVTVSVSLIPFHHSAGLPLPPLVLAMASSASRFIKCVTVGDGAVGKTCMLICYTSNKFPTDYIPTVFDNFSANVVVDGTTVNLGLWDTAGQEDYNRLRPLSYRGADVFVLAFSLVSRASYENVMKKWLPELQHYAPGVPIVLAGTKLDLREDRHYLVDHPGAVPVTTAQGEELRKHIGATCYIECSSKTQQNVKAVFDAAIKVVIRPPTKQRERKKKKERRGCSIFCSRIMHARRLGCFK

SEQ ID NO: 343 - DNA, 474 bp, Zea mays
  CDS (1)..(474)
atgtctagggagttttacacagggaacgaacagtcactcccacatagcatctgcaagttcagcacttgcgaagcatcattatttttaagcacgggaatggtaacacacatgtcaagcagtgatggttgtcttcgaggcggaaccggcgatggcaggcaccagcttcccatcattgttcagtgccatagtatcatcacagccgccaatatgcttcccattgatgaagacatttgggacagtcctctgtccagtccactccttcagggcattctggagctcagctccatcactttccttatccaactcaatggccttgtagcttgctccgagcttctcgaacaactgcttcacacggacgcagaaaggacaggaagttttgctgaagacgacgaggggagcggaggcaacgatctccttggccttggcgagcgccattgctctcgattccgggctggaggttgggctggaggttga

SEQ ID NO: 344 - protein, 157 aa, Zea mays
MSREFYTGNEQSLPHSICKFSTCEASLFLSTGMVTHMSSSDGCLRGGTGDGRHQLPIIVQCHSIITAANMLPIDEDIWDSPLSSPLLQGILELSSITFLIQLNGLVACSELLEQLLHTDAERTGSFAEDDEGSGGNDLLGLGERHCSRFRAGGWAGG

SEQ ID NO: 345 - DNA, 1800 bp, Zea mays
  CDS (1)..(1800)
atggccgatagcggcggaatcagcgccgacaacgccgcggccgctaacgacgacgacgacaccaacacggcgcctttccccgacacggtccaggtcggaggatctcccgagtacaaggtcgagaggaagcttggcaaaggtggcttcggccatgtctttcttggccgacgtctgactgccgcccacgccgcacgctccgcggcgtccgctgcccaagaggttgccatcaagtttgagcacactagcagcaagggctgtacctacggccctccagctgaatggcaaatctacaccgctcttggaggcacacacggcgtgcccaaggtgcattataaaggtcgtcagggtgactactatgtcatgattatggatatgctggggcctagtttgtgggattcatggaattcattaggccaatccatgccatcggaaatggtggcttgcattgccatggagtccatttccatcttggaaagcatgcattctaaaggatatgtgcatggagacgtcaaacctgagaactttcttctggggcagccttcaacgcctcatgaaaagaaactttatcttgtggatcttggattagcaacaaagtggagagatactgctaatgggcagcatgttagttatgatcaacgtcctgatgcctttagaggaacagtcagatatgctagtgtccatgcacatttaggaagaaccgctagcaggagagatgatttggagtcacttgcctatacactagtattccttcaccggggcaggttgccatggcagggatatcagggtgataataaatcatttttggtgtgcaagagaaagatgagtacctcacctgaggccctctgcggcatatgtcctcaacctttcaaggagtttcttgaggccgttgtcaacatgaagtttgatgaagagccaaactattccaagttgatttcattgtttgacagtttaattggaccaatcccttccattagaccaatcaatactgatggagcccaaaaggtagggcagaagcgtgccaggttgcttaatgatgacgacgaccatgtaaaaaagaagattcggctgggtgctcctgcaacacagtggatttcagtatacaattcaaggcaacctatgaagcagaggtaccactataatgtggctgatgcaaggttagcgcaacatgtggagaaaggaaatgaggatggtttgttgataagttcaatatcatcatgcgcaaatctttgggcaatcattatggatgcaggaactggcttctcagctcaagtttatgagctatcttcacactttcttcataaggagtggatcatggaacaatgggataaaagtttctacatcagttctgttgctggctccaacaatggaagttctattgtagtgatgtcaaaaggcacaccatatacacagcaatcttataaagtcagtgattcctttccatttaagtggataaacaagaaatggaaagaaggttttcatgtgactgcaatggcaacatcaggcaatcgatgggctatagtcatgtcccgcagtgctggattttctgagcaggttgtggagttggacttcttgtacccgagcgagggcatccatagacgctgggacaatggcttccgtattactgcaatggctgccacgatggatcagtctgcgctgatcctaagcaagccaaggcgtcgcccaagagacgagacacaagagactctgcggactacacagtttcccagtcaacatgtcaaggacaagtgggccaagaatctctaccttgctgggatatgctatgggcgaaccgtggcctga

SEQ ID NO: 346 - protein, 599 aa, Zea mays
MADSGGISADNAAAANDDDDTNTAPFPDTVQVGGSPEYKVERKLGKGGFGHVFLGRRLTAAHAARSAASAAQEVAIKFEHTSSKGCTYGPPAEWQIYTALGGTHGVPKVHYKGRQGDYYVMIMDMLGPSLWDSWNSLGQSMPSEMVACIAMESISILESMHSKGYVHGDVKPENFLLGQPSTPHEKKLYLVDLGLATKWRDTANGQHVSYDQRPDAFRGTVRYASVHAHLGRTASRRDDLESLAYTLVFLHRGRLPWQGYQGDNKSFLVCKRKMSTSPEALCGICPQPFKEFLEAVVNMKFDEEPNYSKLISLFDSLIGPIPSIRPINTDGAQKVGQKRARLLNDDDDHVKKKIRLGAPATQWISVYNSRQPMKQRYHYNVADARLAQHVEKGNEDGLLISSISSCANLWAIIMDAGTGFSAQVYELSSHFLHKEWIMEQWDKSFYISSVAGSNNGSSIVVMSKGTPYTQQSYKVSDSFPFKWINKKWKEGFHVTAMATSGNRWAIVMSRSAGFSEQVVELDFLYPSEGIHRRWDNGFRITAMAATMDQSALILSKPRRRPRDETQETLRTTQFPSQHVKDKWAKNLYLAGICYGRTVA

SEQ ID NO: 347 - DNA, 531 bp, Zea mays
  CDS (1)..(531)
atgtgccggaaggaaggagagacagaattcttagatcttgtcgatgtcctcgtcctcgaactggatgtagttgtagtcgccgttctcctcgccctcctcgggcccatcgacgtcgacgccctcgttgagcctgagcgtctcgggaagctccccgtaggccttgagcaggcgcgcctcgtcgttcatgtacttgaggatgacgtcggccttgtcgtcctggtagtcgcggaggccgacgaggacgatgtccccggccgcgatccacaccttcttgtgcatcttgccccggatatggcagaggcgacgcgtgccgtccacgcaggtggcctcgcaccgcccgttgccgagcatccgggtcacctgcgcatactcctgcccgtcttccttgaagacgagctcgcgcttgtcgtcgtcagcctcgttctttccacgcttccggttcttgcctcccttacccttgttcttcggcatcttcgcggaggacgagagcggtgtggcgaaaacctagcgcgagatcgaggctcgtgctga

SEQ ID NO: 348 - protein, 176 aa, Zea mays
MCRKEGETEFLDLVDVLVLELDVVVVAVLLALLGPIDVDALVEPERLGKLPVGLEQARLVVHVLEDDVGLVVLVVAEADEDDVPGRDPHLLVHLAPDMAEATRAVHAGGLAPPVAEHPGHLRILLPVFLEDELALVVVSLVLSTLPVLASLTLVLRHLRGGRERCGENLARDRGSC

SEQ ID NO: 349 - DNA, 738 bp, Zea mays
  CDS (1)..(738)
atgttgctgctctccgaccccgagctccgaaggccgcagcatcaggcgcggcccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacgtggcatagggacctgtgcagggtctgtgaaaacatccccattgtcctctgcggtaataaggttgatgtgaagaacaggcaggtcaaagccaagcaggttactttccacaggaagaagaatctgcagtactatgaaatttctgccaagagcaactacaactttgagaaacctttcctgtacctcgcaaggaagctggctggtgatccgaaccttcactttgttgaagctgttgctcttaagcctccggaagttaccatcgacatggctatgcagcagcagcatgaagctgagcttgctgcagcagctgcacaacctcttcctgatgacgatgatgatctgattgagtga

SEQ ID NO: 350 - protein, 245 aa, Zea mays
MLLLSDPELRRPQHQARPPSRVTEMALPNQGTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDPNLHFVEAVALKPPEVTIDMAMQQQHEAELAAAAAQPLPDDDDDLIE

SEQ ID NO: 351 - DNA, 1323 bp, Zea mays
  CDS (1)..(1323)
atgagtacaaccaaggtgaagagacgtgtgggcaagtatgagctcggccggaccataggcgagggcaccttcgcgaaggtcaggttcgcgagggacacggtcaccggcgaggccgtggccattaagatcctggacaaggagaaggtcctcaggcacaagatggttgagcagatcaagcgggagatctcgacgatgaagctgatcaagcaccctaacgtcgtccgcatatacgaggtgatgggaagtaaaacaaagatctacattgtgttagaattcgctaccggtggcgagctctttgatacaattgttaaccatggtcgaatgagggaagacgaggcaaggaggtacttccaacagttaatcaatgcagttgattattgtcatagcaggggtgtgtaccaccgggatttaaaacctgaaaatttgctgcttgattcatatggtaacctgaaggtctctgactttgggctcagcgcgctatctcagcaaatcaaggatgatggactgctgcacacaacttgtgggactccaaactatgttgcaccagaggtccttgaagatcaaggctacgatggagcaatggctgatctgtggtcatgtggagttatcctgtttgttctgctagcagggtatttgccgtttgaggattctaatctcatgactttgtataagaaaatatcaaatgcagaatttacatttccaccatggacatcttttcctgccaagaggttgttaacaagaatccttgatccaaatccaatgacgagaataacaatcccagaaatattagaggatgagtggttcaaaaagggctacaagcgcccagaatttgatgaacaatatgacaccacattggatgatgtggatgccgtcttcaatgattcagaagagcaccatgtgacagaaaagaaagaagaagaaccagtagctctgaacgcattcgaactgatttcgatgtcagcgggcctaaaccttggaaacttatttgactcagagcaggagttcaaaagagaaacaaggtttacatcaaaatgtccccccaaagaaattgtccgcaagatcgaggaagctgcaaaacctctaggatttgatgttcagaagaaaaattacaagttgaggctcgaaaaggtaaaggcagggaggaagggaaacctcaacgttgctactgagatactgcaagttgcgccctctctccacatggtagaagtccgaaaagcaaagggtgacactctggaatttcataagttctacaagaacctttccaagaccttgaaggacgtcgtctggaaatccgacgatcttcaaacgcaacatgcttcttga

SEQ ID NO: 352 - protein, 440 aa, Zea mays
MSTTKVKRRVGKYELGRTIGEGTFAKVRFARDTVTGEAVAIKILDKEKVLRHKMVEQIKREISTMKLIKHPNVVRIYEVMGSKTKIYIVLEFATGGELFDTIVNHGRMREDEARRYFQQLINAVDYCHSRGVYHRDLKPENLLLDSYGNLKVSDFGLSALSQQIKDDGLLHTTCGTPNYVAPEVLEDQGYDGAMADLWSCGVILFVLLAGYLPFEDSNLMTLYKKISNAEFTFPPWTSFPAKRLLTRILDPNPMTRITIPEILEDEWFKKGYKRPEFDEQYDTTLDDVDAVFNDSEEHHVTEKKEEEPVALNAFELISMSAGLNLGNLFDSEQEFKRETRFTSKCPPKEIVRKIEEAAKPLGFDVQKKNYKLRLEKVKAGRKGNLNVATEILQVAPSLHMVEVRKAKGDTLEFHKFYKNLSKTLKDVVWKSDDLQTQHAS

SEQ ID NO: 353 - DNA, 798 bp, Zea mays
  CDS (1)..(798): n means a or g or c or t/u
atgcaagcaccagcgcggcggcggcggcggcggcgaccatggctgtcgggaagaacaagaggatctccaagggaaagaagggtggcaagaaaaagaccgtcgaccctttctctaagaaggattggtatgacatcaaggcaccgtcggtgttcagtgtgcgcaacatcngggaagactctcgtatccaggacacagggtacanggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttggggtatgaattttaccactgataaattgaggtccctagtgaagaagtggcagacattaatcgaagcccatgttgatgtcaagacaaccgacaactacatgttgcgtttgttctgcatcggcttcaccaagaggcgcccaaaccaggtcaagagaacctgctatgctcaggcatcccagatccgtcagatccgccgtaagatggttgagattatgatcaaccaggcttctacatgtgacctgaaagaacttgtttcgaagttcattccagaagttattggtaaggagattgagaagtctacctccagcatcttcccacttcaaaacgtcttcatccgcaaggtgaagatactcaaggcccccaagttcgatcttgggaagctcatggaggttcacggcgactacaaagaggatgttggtgtgaagcttgagaggcctgtcgagggagatgaggcttga

SEQ ID NO: 354 - protein, 265 aa, Zea mays
  misc_feature (68)..(68): Xaa can be Arg or Gly or Trp
MQAPARRRRRRRPWLSGRTRGSPRERRVARKRPSTLSLRRIGMTSRHRRCSVCATSGKTLVSRTQGTXIASEGLKHRVFEVCLADLQGDEDQAYRKIRLRAEDVQGRNVLTNFWGMNFTTDKLRSLVKKWQTLIEAHVDVKTTDNYMLRLFCIGFTKRRPNQVKRTCYAQASQIRQIRRKMVEIMINQASTCDLKELVSKFIPEVIGKEIEKSTSSIFPLQNVFIRKVKILKAPKFDLGKLMEVHGDYKEDVGVKLERPVEGDEA

SEQ ID NO: 355 - DNA, 564 bp, Zea mays
  CDS (1)..(564)
atgcggttcatcaagtgcgtcacggtcggcgacggtgccgtgggcaagacatgtatgctcatctgctacaccagcaacaagttccccactgactacatacctacggtgttcgacaatttcagtgcaaatgtagttgtggatggcaccactgtgaatttgggcctttgggataccgctgggcaggaagattacaaccgcctgaggcctctaagctaccgaggtgcagatgttttcgtgcttgcattctcacttgtgagccgagctagctatgagaatatcatgaagaagtggataccagagcttcaacattatgcacctggggtgcccgttgttttggcaggcacaaaattggatcttcgtgaagacaagcactacttgatggaccatcctggattggtgcctgttaccactgcacagggggaggaacttcgtagacaaattggtgctatgtattacattgaatgcagctcaaagacacagcagaatgtcaaagctgtgttcgatgctgccatcaaggtagtaatccagcctccaactaaaataagagataaaaaaaaaaaatga

SEQ ID NO: 356 - protein, 187 aa, Zea mays
MRFIKCVTVGDGAVGKTCMLICYTSNKFPTDYIPTVFDNFSANVVVDGTTVNLGLWDTAGQEDYNRLRPLSYRGADVFVLAFSLVSRASYENIMKKWIPELQHYAPGVPVVLAGTKLDLREDKHYLMDHPGLVPVTTAQGEELRRQIGAMYYIECSSKTQQNVKAVFDAAIKVVIQPPTKIRDKKKK

SEQ ID NO: 357 - DNA, 570 bp, Zea mays
  CDS (1)..(570)
atgggagagagattccgacaccgctgggctcagatgccgccgccgccgccgccgccgcagcagcagcagcagcagtccggcatgactctctgccgcctccccacggccactcttggccttcccctttctctcccctgtttgctacctcgttcccgcccccgcctgtgcttcgccgcacgtcatgccagggccgtcgccgccagggcttcctcatcctctccatcaccggactcttcattcggttcgcggatggaggagtccgtcaagaagacggtggccgacaaccccgttgtcatctactccaagtcatggtgctcatattgcatggaggtgaaggcgctcttcaagcggatcggtgtgcagccccatgttatcgagcttgaccatctcggtgctcaaggaccacaaatacagaaggtattagagaggctgactggacagtctactgttcctaatgttttcatcggtggaaagcatgttggtggctgtacagatactgtgaagctgtatcgcaagggggagctagctagcatgctgtccggcctggatatcaacattaacaactcatga

SEQ ID NO: 358 - protein, 189 aa, Zea mays
MGERFRHRWAQMPPPPPPPQQQQQQSGMTLCRLPTATLGLPLSLPCLLPRSRPRLCFAARHARAVAARASSSSPSPDSSFGSRMEESVKKTVADNPVVIYSKSWCSYCMEVKALFKRIGVQPHVIELDHLGAQGPQIQKVLERLTGQSTVPNVFIGGKHVGGCTDTVKLYRKGELASMLSGLDININNS

SEQ ID NO: 359 - DNA, 1410 bp, Zea mays
  CDS (1)..(1410)
atgccgcgtgagatcatcacgatccaggtggggcaatgtggaaaccagatcgggatggagttctggaagcagctctgtctcgagcacggtatcggcaaggacggcctgctcgaggacttcgccactcaggggggcgacaggaaggacgtcttcttttaccaggctgatgatcagcacttcatacccaggtctctgcttattgacctggagccgagagtgatcaatggaatccagaacagtgagtacaggaacctgtacaaccacgagaacatatttgtcgctgagcatggtggtggtgccgggaacaactgggccagtgggtatcatcagggtgaacaagttgttgatgatatcatggacatggttgacagagaagcagatggaagtgatagccttgagggttttgtcctttgtcattctattgctggtggaactggttcaggtatgggttcttatctgttggagacactgaatgatcgatacagtaaaaagcttgtgcagacatatagtgttttcccaaatcagatggaaacaagtgatgttgtcgtccaaccttacaactcacttttaactctgaagcgtctgacactgaatgctgactgtgtggtggttcttgacaatacggctcttaataggattgcggtcgagcgtcttcatttatcaaatcctacatttgcacaaacaaactctttggtctccacagttatgtctgcaagcacaactacattgcggtatcctggatatatgaacaatgatctggttggccttcttgcctccctgatccccactccaaggtgtcattttttgatgacaggctatactccactgactgttgagcgccaggttaacatgatacgcaaaacaacagtattggatgttatgagaagacttctgcagacaaagaatgtaatggtgtcatcatatgctcgaacaaaagaagccagccaggctaaatatatctccatattgaacatcattcaaggggaggtggaccctacacaggttcatgagagcctgcaaaggatacgtgaaaggaagcttgttaactttatagactgggcacctgcaagcattcaggttgccctgtcaagaaaatccccatatgttcaaacaacccacagggttagtggtctgatgttagctaatcatacgagcatccgccacctgttcggcaaatgcctgggacaatatgaaaagctaaggaaaaagcaggcttttcttgacaactataggaaattcccaatgtttgcagataatgatctctctgaatttgatgaatctcgagagataatagagagcctagttgatgaatacaaggcctgtgagtcgccagactacattaaatggggaatggaggaccctggagaggcaaacgttgcagcagatcttgactctaagttggtagtgtga

SEQ ID NO: 360 - protein, 469 aa, Zea mays
MPREIITIQVGQCGNQIGMEFWKQLCLEHGIGKDGLLEDFATQGGDRKDVFFYQADDQHFIPRSLLIDLEPRVINGIQNSEYRNLYNHENIFVAEHGGGAGNNWASGYHQGEQVVDDIMDMVDREADGSDSLEGFVLCHSIAGGTGSGMGSYLLETLNDRYSKKLVQTYSVFPNQMETSDVVVQPYNSLLTLKRLTLNADCVVVLDNTALNRIAVERLHLSNPTFAQTNSLVSTVMSASTTTLRYPGYMNNDLVGLLASLIPTPRCHFLMTGYTPLTVERQVNMIRKTTVLDVMRRLLQTKNVMVSSYARTKEASQAKYISILNIIQGEVDPTQVHESLQRIRERKLVNFIDWAPASIQVALSRKSPYVQTTHRVSGLMLANHTSIRHLFGKCLGQYEKLRKKQAFLDNYRKFPMFADNDLSEFDESREIIESLVDEYKACESPDYIKWGMEDPGEANVAADLDSKLVV

SEQ ID NO: 361 - DNA, 504 bp, Zea mays
  CDS (1)..(504): n means a or g or c or t/u
atgagacagcccgtcagcccctctcgtttttcatccgccttcgcctccaaccgcgtgcgctccacgcctcctccaggaaagcgagagcttctgcataagaacaacaaatcaaaagncttgatcagctcggtgcctacaaaacctcaacaaccaagtttcatgtctgatctcgacgtccagcttccatctgcctttgatccgtttgctgaggcaaatgctgaggactctggtgctggtcctggaacgaaggattatgtgcatgtgcgcatccagcagcgcaacggcagaaagagtctgactacagtccagggtctgaagaaagagttcagctataacaagatcctcaaggatctgaagaaggaattctgctgcaatggtactgtagttcaggacccagagctaggccaggtcattcagctccaaggtgaccagcgcaagaatgttgctactttcctagttcaggctgggattgcgaagaaagagaacatcaagattcacgggtga

SEQ ID NO: 362 - protein, 167 aa, Zea mays
  misc_feature (39)..(39): Xaa can be Ala or Asp or Gly or Val
MRQPVSPSRFSSAFASNRVRSTPPPGKRELLHKNNKSKXLISSVPTKPQQPSFMSDLDVQLPSAFDPFAEANAEDSGAGPGTKDYVHVRIQQRNGRKSLTTVQGLKKEFSYNKILKDLKKEFCCNGTVVQDPELGQVIQLQGDQRKNVATFLVQAGIAKKENIKIHG

SEQ ID NO: 363 - DNA, 666 bp, Zea mays
  CDS (1)..(666): n means a or g or c or t/u
atgcgcaacgccaagctggttcttcttggagatgtgggcgctggcaaatctagcttggttcttcggtttgttaagggacagttttttgaattccaggaatcaacaattggagcagccttcttttcccagaccttagcggtcaatgatgagactgttaagttcgaaatctgggatactgccgggcaggagaggtatcatagcttggctcccatgtactataggggtgcagctgctgccattgttgtctatgacatcacaaatccggcctccttcacccgtgccaagaaatgggttcaagaacttcaagctcaaggaaatcagaataccatagtggctcttgctggaaacaaggctgatatgctagatgcgaggcaggtgccagcagaggaagcaaaggcgtatgctcaggagaatgggctcttcttcatggagacatctgctaaaactgcaatcaatgtgaatgacatattttatgagattgcaaagaaattgcttcaagggcaacaagctccaagcccacaggctggaatggttctgaatcagagaccaaatgnagaggacggtcagcagttcttcatgctgctctntgagctgtgtttcaacctcgtagtgccgttatcaaatgtatcagaggaggtttatggaaaatatcccatgtcgctttga

SEQ ID NO: 364 - protein, 221 aa, Zea mays
  misc_feature (185)..(185): Xaa can be Ala or Glu or Gly or Val
  misc_feature (196)..(196): Xaa can be Cys or Phe or Ser or Tyr
MRNAKLVLLGDVGAGKSSLVLRFVKGQFFEFQESTIGAAFFSQTLAVNDETVKFEIWDTAGQERYHSLAPMYYRGAAAAIVVYDITNPASFTRAKKWVQELQAQGNQNTIVALAGNKADMLDARQVPAEEAKAYAQENGLFFMETSAKTAINVNDIFYEIAKKLLQGQQAPSPQAGMVLNQRPNXEDGQQFFMLLXELCFNLVVPLSNVSEEVYGKYPMSL

SEQ ID NO: 365 - DNA, 1242 bp, Zea mays
  CDS (1)..(1242)
atgacgaggacccggcgctcgcgcggctttctttcccaactccgacgaaggctagctacaccacctggtgcgggctcgtctccatcgcccgccacccgctccgtcgtcgtcgtccccgccgcgccgatcccgaatcgaatggggagcctggcgtccgagaggaaggtggtcgggtgggccgccagggacgccaccggacacctctccccctactcctacaccctcaggaacacaggccctgaagatgtggtggtgaaggtgctctactgcgggatctgccacacggacatccaccaggccaagaaccacctcggggcttcaaagtatcctatggtccctgggcacgaggtggtcggcgaggtggtggaggtcgggcccgaggtggccaagtacggcgtcggcgacgtggtaggcgtcggggtgatcgttgggtgctgccgcgagtgcagcccctgcaaggccaacgttgagcagtactgcaacaagaagatctggtcatacaacgacgtctacactgatggacggcccacgcagggtggattcgcctccaccatggtcgtcgaccagaagtttgtggtgaagatcccggcgggtctggctccggagcaagcggcgccgctgctgtgcgctggcgtgacggtgtacagcccgctgaagcactttgggctgacgaccccgggcctccgtggcggcatcctgggcctcggcggcgtgggccacatgggcgtgaaggtagccaaggccatgggccaccacgtgacggtgatcagctcgtcgtccaagaagcgcgcggaggcaatggaccacctcggcgcggacgcgtacctagtgagctcggacgccgcggccatgggggcggccgccgactcgctggactacatcatcgacacggtgcccgtgcaccacccgctggagccgtacctggcgctgctgaagctggacggcaagctcgtgctgctgggcgtcatcggcgagcccctgagcttcgtgtcgcccatggtgatgctggggcggaaggccatcacggggagcttcatcggcagcatcgacgagaccgctgaggtgcttcagttctgcgtcgacaaggggctcacctcccagatcgaggtggtcaagatggggtacgtgaacgaggcgctggagcggctggagcgcaacgacgtccgctaccgcttcgtcgtcgacgtcgccggtagcaacgtcgaggcggaggcggcggcggcggatgcggccagcaactga

SEQ ID NO: 366 - protein, 413 aa, Zea mays
MTRTRRSRGFLSQLRRRLATPPGAGSSPSPATRSVVVVPAAPIPNRMGSLASERKVVGWAARDATGHLSPYSYTLRNTGPEDVVVKVLYCGICHTDIHQAKNHLGASKYPMVPGHEVVGEVVEVGPEVAKYGVGDVVGVGVIVGCCRECSPCKANVEQYCNKKIWSYNDVYTDGRPTQGGFASTMVVDQKFVVKIPAGLAPEQAAPLLCAGVTVYSPLKHFGLTTPGLRGGILGLGGVGHMGVKVAKAMGHHVTVISSSSKKRAEAMDHLGADAYLVSSDAAAMGAAADSLDYIIDTVPVHHPLEPYLALLKLDGKLVLLGVIGEPLSFVSPMVMLGRKAITGSFIGSIDETAEVLQFCVDKGLTSQIEVVKMGYVNEALERLERNDVRYRFVVDVAGSNVEAEAAAADAASN

SEQ ID NO: 367 - DNA, 342 bp, Zea mays; identical to SEQ ID NO: 251
  CDS (1)..(342)

SEQ ID NO: 368 - protein, 113 aa, Zea mays; identical to SEQ ID NO: 252

SEQ ID NO: 369 - DNA, 816 bp, Zea mays
  CDS (1)..(816)
atgagatggggaatggcttggccaagcacctttgccaaggtttaccatgctcgtaacacggcgacttcggaaagtgtcgcgatcaaagtgattgataaggagaaggttatgaaggttggtctcattgatcaaatccagcgagaaatttctgtgatgaagcttgttaggcatccaaacatcgtacagctctatgaggtcatggccaccaaaaccaaaatatactttgtgctggaacatgttaaaggtggagagctgttcaacaagattcagcgaggaaggctcaaggaagacgcagcgaggaagtacttccagcagttgatctgtgcggtggacttctgccacagcaggggtgtctatcatcgagatttgaagccagaaaatcttttgctcgatgagaatagcaacctaaaggtatcagattttggtctaagcgcacttgctgaatgccatagacaagacggcctgctccacacgacttgtggcacgcctgcttatgttgccccagaggtgattaacagaaagggttatgatggtgcaaaggctgacatatggtcttgtggggtcatcctgtttgtgctattggctggttatcttccgttccatgataagaacttgatggacatgtataagaagattgagaaagctgacttcaaatgtccaagttggttttctaccgatgttcggaggcttttgcaaaggattcttgatcctaaccctagtagaaggatctcgatggaaaaaatcatggagaatccatggtttaggaagggtttaggtgcaaagctacttagatacgatttacagaataagaattga

SEQ ID NO: 370 - protein, 271 aa, Zea mays
MRWGMAWPSTFAKVYHARNTATSESVAIKVIDKEKVMKVGLIDQIQREISVMKLVRHPNIVQLYEVMATKTKIYFVLEHVKGGELFNKIQRGRLKEDAARKYFQQLICAVDFCHSRGVYHRDLKPENLLLDENSNLKVSDFGLSALAECHRQDGLLHTTCGTPAYVAPEVINRKGYDGAKADIWSCGVILFVLLAGYLPFHDKNLMDMYKKIEKADFKCPSWFSTDVRRLLQRILDPNPSRRISMEKIMENPWFRKGLGAKLLRYDLQNKN

SEQ ID NO: 371 - DNA, 411 bp, Zea mays
  CDS (1)..(411)
atggaacaacaaatcaaaagcttgatcagctcggtgcctacaaaacctcaacaaccaagtttcatgtctgatctcgacgtccagcttccatctgcctttgatccgtttgctgaggcaaatgctgaggactctggtgctggtcctggaacgaaggattatgtgcatgtgcgcatccagcagcgcaacggcagaaagagtctgactacagtccagggtctgaagaaagagttcagctataacaagatcctcaaggatctgaagaaggaattctgctgcaatggtactgtagttcaggacccagagctaggccaggtcattcagctccaaggtgaccagcgcaagaatgttgctactttcctagttcaggctgggattgcgaagaaagagaacatcaagattcacgggttctga

SEQ ID NO: 372 - protein, 136 aa, Zea mays
MEQQIKSLISSVPTKPQQPSFMSDLDVQLPSAFDPFAEANAEDSGAGPGTKDYVHVRIQQRNGRKSLTTVQGLKKEFSYNKILKDLKKEFCCNGTVVQDPELGQVIQLQGDQRKNVATFLVQAGIAKKENIKIHGF

SEQ ID NO: 373 - DNA, 1383 bp, Zea mays
  CDS (1)..(1383)
atggtgaacggcgagcggcgggcggacgcggagtgcacgcgggcgtcgctgctggggaggtatgagatcgggcggaccctcggcgagggcaacttcggcaaggtgaagtacgcgcgccacatcgccagcggcggccacttcgccatcaagatcctcgaccgcagcaagatcctctccctccgcatcgacgaccagatcaggagggagatcgggacgctcaagctgctcaagcacccgaatgtcgtccgcttgcacgaggttgctgccagtaaaacgaagatctacatggtgcttgagtttgtcaacggcggcgagctcttcgacaagatcgctatcaaggggaaactgtccgaacacgagggcaggaggctcttccagcagctaatcgacggcgtcagctattgccatgacagaggtgtctaccaccgagacctcaagccagagaatgtccttgttgatcggaagggcaccatcaagatctctgacttcggcctcagcgctctacctcaacatctcgggagtgacggacttctgcacacaacatgtggcagccccaactacatagctcctgaggttctgcaaaacagaggctatgacggctccttgtcagatctctggtcgtgtggggtgatcctctacgtgatgcttgttggctgccttcccttcgacgacaggaacctcgtcgttctttatcagaagattttcaagggagactgtcagatccccaagtggctttcgcctgccgcgcaggaccttctcaagaggatcctccaaccgaatccgatgaagaggatcaacgtcgcggggatcagggagcacgagtggttcaagaaggactacgtgcctgctgttccgcacgatgatgacgaagacgtccttcctagtccagctccctcgataaagccaatcgatgagccggcgcaagagaagtgttctcctatcaacgcttttcagttgatcgggatggcctcttcccttgacctttctggtttcttcgaggaagaggatgcagcgcaaagaaagattcggttcacttcgacgcacccacccaaggatctatttgacaagatcgagagcgttgtcatggagatgggattcaaagtccataggggggcaggcaagctcaaggtcttgaagaatagcaagtgttccaggaacccgtcatcattgttggtgtgcaccgaggtgtttgagctcggtccatcattatatgtcgtagagcttaggaaatcccacggagactctacgttgtatagacagctgtgcgaaaggctctccgatgagctaggtgcctgcaagacagaccagatcgcgaggactgaatcatcgagtgacgacctctcgagcgtcgatggcgaagcgttccctctatctgggttctga

SEQ ID NO: 374 - protein, 460 aa, Zea mays
MVNGERRADAECTRASLLGRYEIGRTLGEGNFGKVKYARHIASGGHFAIKILDRSKILSLRIDDQIRREIGTLKLLKHPNVVRLHEVAASKTKIYMVLEFVNGGELFDKIAIKGKLSEHEGRRLFQQLIDGVSYCHDRGVYHRDLKPENVLVDRKGTIKISDFGLSALPQHLGSDGLLHTTCGSPNYIAPEVLQNRGYDGSLSDLWSCGVILYVMLVGCLPFDDRNLVVLYQKIFKGDCQIPKWLSPAAQDLLKRILQPNPMKRINVAGIREHEWFKKDYVPAVPHDDDEDVLPSPAPSIKPIDEPAQEKCSPINAFQLIGMASSLDLSGFFEEEDAAQRKIRFTSTHPPKDLFDKIESVVMEMGFKVHRGAGKLKVLKNSKCSRNPSSLLVCTEVFELGPSLYVVELRKSHGDSTLYRQLCERLSDELGACKTDQIARTESSSDDLSSVDGEAFPLSGF

SEQ ID NO: 375 - DNA, 579 bp, Zea mays
  CDS (1)..(579): n means a or g or c or t/u
atggaaggaaaattccagcggacgagcgctctaagccgtttttcctcgtcctcgatccagccccctgccgcttcangctccgatcgatctgatccctccccaccaccnacgcccatggcggaccaactcaccgacgaccagatcgccgagttcaaggaggccttcagcctcttcgacaaggacggggatggttgcatcacgaccaaggagctgggaactgtcatgcgttcactggggcaaaaccctacagaggctgagctccaggacatgatcaatgaggtcgatgccgacggcaacggcaccatcgattttccagagtttctcaaccttatggctcgcaagatgaaggacaccgactctgaggaagagctcaaggaggcctttcgtgtgtttgacaaggaccagaacggcttcatctctgccgccgagctccgccatgtcatgacaaatcttggggagaagctaactgatgaggaggtagacgagatgatccgtgaggctgatgtcgatggtgatggccagattaactacgaggagtttgttaaggtcatgatggccaaangagccacagaagcatga

SEQ ID NO: 376 - protein, 192 aa, Zea mays
  misc_feature (26)..(26): Xaa can be Ser or Arg or Gly or Cys
  misc_feature (188)..(188): Xaa can be any amino acid
MEGKFQRTSALSRFSSSSIQPPAASXSDRSDPSPPPTPMADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAKXATEA

SEQ ID NO: 377 - DNA, 1269 bp, Zea mays
  CDS (1)..(1269)
atggatgtcttcttttaccaggctgatgatcagcacttcatacccaggtctctgcttattgacctggagccgagagtgatcaatgggattcagaacagcgagtacaggaacctgtacaaccatgagaacatatttgttgctgagcacggtggtggtgccgggaacaactgggccagtgggtatcatcagggtgaacaatttgttgatgatatcatggacatggttgacagagaagctgatggaagtgatagccttgagggttttgtcctgtgccactctattgctggtggaactggttcaggtatgggttcttatctattggagacactgaatgatcgatacagtaaaaagcttgtgcagacatatagtgttttcccaaatcaggtggaaacaagtgatgttgtcgtccaaccttacaactcacttttgactctgaagcggctgacactgaatgctgactgtgtggttgttcttgacaatacggctcttaataggattgccgtcgagcgccttcatctatcaaatcctacgtttgcacaaacaaactctttggtctccacggttatgtctgcaagcacaactactttaaggtatcctggatatatgaacaatgatctggttggccttcttgcctccttgattcccactccaaggtgtcattttttgatgacaggttatactccgttgactgtcgagcgccaggttaacatgatacgcaaaacgacggtattggatgttatgagaagacttctgcagacaaagaatataatggtgtcatcatatgctcgaacaaaagaagctagccaggctaaatacatctccatattgaacatcattcaaggggaggtggaccctacacaggttcacgagagcctgcaaagaatacgcgaaaggaagcttgttaactttatagactgggcacctgcaagcattcaggttgctttgtcaagaaaatccccttatgttcaaacaacccacagggttagtggtctgatgttagcaaatcatacaagcatccgtcatttattcagcaaatgcctgggacaatatgaaaagctaaggaaaaagcaggcttttcttgacaactacaggaagttcccaatgtttgcggacaatgatctatctgaatttgatgaatctcgagagataatagagagcctagttgatgaatacaaggcctgcgagtcgcctgactacatcaaatggggaatggaggaccctggagaggcaaatgttgtggcggcacttgactctaagttggtagtgtga

SEQ ID NO: 378 - protein, 422 aa, Zea mays
MDVFFYQADDQHFIPRSLLIDLEPRVINGIQNSEYRNLYNHENIFVAEHGGGAGNNWASGYHQGEQFVDDIMDMVDREADGSDSLEGFVLCHSIAGGTGSGMGSYLLETLNDRYSKKLVQTYSVFPNQVETSDVVVQPYNSLLTLKRLTLNADCVVVLDNTALNRIAVERLHLSNPTFAQTNSLVSTVMSASTTTLRYPGYMNNDLVGLLASLIPTPRCHFLMTGYTPLTVERQVNMIRKTTVLDVMRRLLQTKNIMVSSYARTKEASQAKYISILNIIQGEVDPTQVHESLQRIRERKLVNFIDWAPASIQVALSRKSPYVQTTHRVSGLMLANHTSIRHLFSKCLGQYEKLRKKQAFLDNYRKFPMFADNDLSEFDESREIIESLVDEYKACESPDYIKWGMEDPGEANVVAALDSKLVV

SEQ ID NO: 379 - DNA, 801 bp, Zea mays
  CDS (1)..(801)
atgttcgatcaggtcatcatcgtcatcagggaggggttgcgcagcggcagctgcaagctcagcttcatgctgctgctgcatggccatatcaatctgcacttccggtggcttcagagcaacggcttcgacaaagtgaaggttctgatcccctgccagcttccttgcgaggtaaaggaagggcttctcaaagttgtaattgctcttggcagaaatctcatagtactgcaagttcttcttcctgtggaatgtaacttgcttggctttgacctgcctgttctttacatcaaccttgtttccgcagagaacgatggggatgttctcacacaccctgcacaggtccctgtgccatgttggaacattcttgtatgtcagcctcgaagtgacatcaaacataatgatggcacactgaccatgaatgtagtagccatccctgaggccaccgaacttttcttgcccagcagtgtcccagcaatagaagcgaattttgccacagttagtgctaaaatccagagggtgaacttcaacaccaatggtgggctcatatttcttctcaaactcgccagtaagatgcctcttcacaaatgtggttttgccagttccaccgtcgccaacgatgacgagcttgaagctggggtaatccacaacctgctgattcggcagcgccatttctgcggcggggcgcggcgaacagagaccgctgcggcggccaagagtttgaaatgtataactagagagaagagaagtagagggcgtctggcgtctggactctggacgaaatcgtcgacagcgaagtcgacctga

SEQ ID NO: 380 - protein, 266 aa, Zea mays
MFDQVIIVIREGLRSGSCKLSFMLLLHGHINLHFRWLQSNGFDKVKVLIPCQLPCEVKEGLLKVVIALGRNLIVLQVLLPVECNLLGFDLPVLYINLVSAENDGDVLTHPAQVPVPCWNILVCQPRSDIKHNDGTLTMNVVAIPEATELFLPSSVPAIEANFATVSAKIQRVNFNTNGGLIFLLKLASKMPLHKCGFASSTVANDDELEAGVIHNLLIRQRHFCGGARRTETAAAAKSLKCITREKRSRGRLASGLWTKSSTAKST

SEQ ID NO: 381 - DNA, 621 bp, Zea mays
  CDS (1)..(621): n means a or g or c or t/u
atgtctccagcaccacagccaccgccacagttacagtcagcgaganagagcatggacctgctgaaccccgagcagatctccgagttccgggaggcgttcgcgttcttcgacaaggacggcgacgggtgcatcacggtggaggagctggcgacggtgatggggtcgctgcaggggcagcggcccagcgcggaggagctgcgcgagatgatccgcgacgccgacgccgacggcaacggcgccatcgacttcgccgagttcctgggcctcatggcgcgcaagaccgcggggggcggcgccggcggcggcgccgaccccgacgaggagctgcgcgaggcgttcaaggtgttcgacaaggaccagaacgggtacatctccgccaccgagctccgccacgtcatgatcaacctcggcgagaagctcacggacgaggaggtggagcagatgatccgcgaggccgacctcgacggcgacggccaggtcaactacgacgagttcgcnccggatgatgatgctctccgacggcgccggcgccggcgccgcagccacgggccaccaccaatgaacccatctccacctttcgtcagcctagcgcttcccatcacgtccgttgccgatggatga

SEQ ID NO: 382 - protein, 206 aa, Zea mays
  misc_feature (16)..(16): Xaa can be any amino acid
MSPAPQPPPQLQSARXSMDLLNPEQISEFREAFAFFDKDGDGCITVEELATVMGSLQGQRPSAEELREMIRDADADGNGAIDFAEFLGLMARKTAGGGAGGGADPDEELREAFKVFDKDQNGYISATELRHVMINLGEKLTDEEVEQMIREADLDGDGQVNYDEFAPDDDALRRRRRRRRSHGPPPMNPSPPFVSLALPITSVADG

SEQ ID NO: 383 - DNA, 1350 bp, Zea mays; identical to SEQ ID NO: 317
  CDS (1)..(1350)

SEQ ID NO: 384 - protein, 449 aa, Zea mays; identical to SEQ ID NO: 318

SEQ ID NO: 385 - DNA, 903 bp, Zea mays
  CDS (1)..(903)
atgcaggcaaagattcaaagcgagatctcaacattcctaatgtacgcggggagcacctgcagcgccgccagacactccgtagtctgtaccccaagcaccggcgcggcggcggcggctaccatggcagtcgggaagaacaagaggatctccaagggaaagaagggtggtaagaaaaagaccgtcgatcccttctctaagaaggactggtatgacatcaaggccccatcggtcttcagtgtgcgcaacattgggaagactctcgtgtccaggacacagggtaccaggattgcctctgatggtctgaagcacagagtctttgaggtttgtctagctgatcttcagggtgacgaggatcaggcttacaggaaaatcaggctccgtgctgaagatgtgcaaggcaggaatgtgctcacaaacttctggggcatgaattttaccaccgataagctcagatctctagtaaagaagtggcagacattgattgaagcccatgttgatgtcaagacaaccgacaactacatgctgcgtttgttctgcattggttttaccaagaggcgcccaaaccaggtcaagagaacctgctatgctcaggcatcccagattcggcagattcgccgcaagatggttgagattatgatcaaccaggcttctacatgtgaccttaaagaacttgtttctaagttcattccggaagttattggcaaagagattgagaagtctacctccagcatcttcccacttcaaaacgtcttcatccgcaaggtgaagatactcaaggcccccaagtttgatctcgggaagttgatggaggttcatggcgactacaaagaggacgttggtgtgaagcttgagaggcctgtcgagggtgatgaggctatgcaggaggttgctgctgccgagtga

SEQ ID NO: 386 - protein, 300 aa, Zea mays
MQAKIQSEISTFLMYAGSTCSAARHSVVCTPSTGAAAAATMAVGKNKRISKGKKGGKKKTVDPFSKKDWYDIKAPSVFSVRNIGKTLVSRTQGTRIASDGLKHRVFEVCLADLQGDEDQAYRKIRLRAEDVQGRNVLTNFWGMNFTTDKLRSLVKKWQTLIEAHVDVKTTDNYMLRLFCIGFTKRRPNQVKRTCYAQASQIRQIRRKMVEIMINQASTCDLKELVSKFIPEVIGKEIEKSTSSIFPLQNVFIRKVKILKAPKFDLGKLMEVHGDYKEDVGVKLERPVEGDEAMQEVAAAE

SEQ ID NO: 387 - DNA, 399 bp, Zea mays
  CDS (1)..(399)
atgcaggttgctccggccgcatccccgccgaccgccgaccgccgaccgccgacgatgcctcccaaggccaagaaggacgctgcgccgtctgagcgccccatccttggacgcttctcctcccacctcaagatcgggatcgttgggttgccaaatgttggcaaatcaacttttttcaacatagtaacaaagttggctatcccagctgagaattttcctttctgtaccatcgaaccaaatgaagcacgggtgaatgttccagatgaacggtttgattggctctgcaaactttacaagccaaagagtgaggtgcctgcatatcttgaagtaactgacatagctgggcttattagaggtgctcatgctggggatggtctgggcaatgcattcctctcacattga

SEQ ID NO: 388 - protein, 132 aa, Zea mays
MQVAPAASPPTADRRPPTMPPKAKKDAAPSERPILGRFSSHLKIGIVGLPNVGKSTFFNIVTKLAIPAENFPFCTIEPNEARVNVPDERFDWLCKLYKPKSEVPAYLEVTDIAGLIRGAHAGDGLGNAFLSH

SEQ ID NO: 389 - DNA, 615 bp, Zea mays
  CDS (1)..(615)
atggatcacatacaagtgtcacctccccggtccctcgcgaaccctagagccgcagcagcacactcccgcagtagcagcagccgccgccgccgccgcccagccgcaggaaacaggaggaagatgccggcggggcacgggcttcggtcgcggacccgcgacctgttcgcgcggccgttccgcaagaagggttacatcccgctcaccacgtacctgcgcacctacaagatcggcgactacgtcgacgtcaaggtgaacggcgccgtgcacaagggcatgccgcacaagttctaccacggccgcaccggtcgcgtctggaacgtcaccaagcgcgccatcggcgttgagatcaacaagcaggttaatggccgcatcatcaggaagcgtatccatgtccgtgtggagcatgtgcagccctcccgttgcacagaggagttccgcttgaggaaagccaagaacgatcagctcaaggttgatgccaaggaccgtggcgaggtgatcagcaccaagaggcagcctgtgggacccaaacctggcttcatggttgagggtgctacacttgagaccgttactcctattccctatgatgtggtaaatgatctcaaggggggttactga

SEQ ID NO: 390 - protein, 204 aa, Zea mays
MDHIQVSPPRSLANPRAAAAHSRSSSSRRRRRPAAGNRRKMPAGHGLRSRTRDLFARPFRKKGYIPLTTYLRTYKIGDYVDVKVNGAVHKGMPHKFYHGRTGRVWNVTKRAIGVEINKQVNGRIIRKRIHVRVEHVQPSRCTEEFRLRKAKNDQLKVDAKDRGEVISTKRQPVGPKPGFMVEGATLETVTPIPYDVVNDLKGGY

SEQ ID NO: 391 - DNA, 1017 bp, Zea mays
  CDS (1)..(1017)
atgcggcacttggtctctgcttgcatgctgctgcagtgctgcctccccctcgccctacccctcgcccagcagcaggcagcagtcatgccaggggaccacggctccaagggcgacatctccttcgccggacgcttcacggccagcgccatcgcagcatgcttcgcagagatatgtaccatcccgctcgacacggccaaggtcaggctccagctgcagaagaacgtcgtcgccgccgccgcctccggggacgccgcgccagcgcttcccaagtaccgcggcctgctcggaactgccgccaccatcgctagggaggaaggggccgcagcgctctggaagggcatcgtcccgggcctccaccgacagtgcatctacggggggctccgcattggcctctacgagcctgtcaaatccttctacgtcggcaaagaccacgttggggatgtccctttgtccaagaagatagccgccggcttcacaactggtgccatcgctatcagcatcgccaaccctactgaccttgtcaaggtcaggctccaggccgagggcaagcttgcgcctggtgtgccacgccgctacactggcgcaatggatgcttattccaagattgctagacaggaaggggttgccgctctgtggactggccttggaccaaatgtagcgcggaatgctatcatcaatgctgctgagttggccagttatgatcaagtcaagcagtcaattttgaaactccctgggttcaaagatgatgtggtcacccacctttttgctggtcttggtgctggcttctttgctgtttgtgttggttccccagttgatgtggttaagtcgagaatgatgggtgactcagcctacaaaagcactctcgattgttttgtgaagacgctaaagaatgatggccctttggcattttacaaaggcttcctgccaaactttgcaagactgggatcttggaatgtgattatgttcttgacattggagcaggttcaaaagctgtttgtgaggaaagcgacaagctga

SEQ ID NO: 392 - protein, 338 aa, Zea mays
MRHLVSACMLLQCCLPLALPLAQQQAAVMPGDHGSKGDISFAGRFTASAIAACFAEICTIPLDTAKVRLQLQKNVVAAAASGDAAPALPKYRGLLGTAATIAREEGAAALWKGIVPGLHRQCIYGGLRIGLYEPVKSFYVGKDHVGDVPLSKKIAAGFTTGAIAISIANPTDLVKVRLQAEGKLAPGVPRRYTGAMDAYSKIARQEGVAALWTGLGPNVARNAIINAAELASYDQVKQSILKLPGFKDDVVTHLFAGLGAGFFAVCVGSPVDVVKSRMMGDSAYKSTLDCFVKTLKNDGPLAFYKGFLPNFARLGSWNVIMFLTLEQVQKLFVRKATS

SEQ ID NO: 393 - DNA, 435 bp, Zea mays
  CDS (1)..(435)
atgccgaagaacaagggtaagggaggcaagaaccggaagcgaggaaagaacgaggctgacgacgacaagcgcgagctcgtcttcaaggaagacgggcaggagtacgcgcaggtgacccggatgctcggcaacgggcggtgcgaggccatctgcgtcgatggcacgcgccgcctctgccatatccggggtaagatgcacaagaaggtctggatcgcggctggggacatcgtcctcgtcggcctccgcgactaccaggacgacaaggccgacgttatcctcaagtacatgaacgacgaggcgcgcctgctcaaggcctacggggagcttcctgacacgctcaggctcaacgagggcgtcgacgtcgatgggcccgaggaaggcgaggagggcagcgactacatccagttcgaggacgaggacatcgacaagatctga

SEQ ID NO: 394 - protein, 144 aa, Zea mays
MPKNKGKGGKNRKRGKNEADDDKRELVFKEDGQEYAQVTRMLGNGRCEAICVDGTRRLCHIRGKMHKKVWIAAGDIVLVGLRDYQDDKADVILKYMNDEARLLKAYGELPDTLRLNEGVDVDGPEEGEEGSDYIQFEDEDIDKI

SEQ ID NO: 395 - DNA, 1350 bp, Zea mays
  CDS (1)..(1350)
atgagcgcatccgtgggccggacccgcgtggggcggtacgagctcggccggaccctcggcgaaggcaccttcgccaaggtcaagttcgcccggaacgtcgagaccggagagaatgtcgccatcaagatcctcgacaaggagaaggtcctcaagcacaagatgatcgcccagatcaagcgagagatctcgaccatgaagctcatcaggcaccccaacgtcatccggatgtatgaggtgatggccagcaagacaaagatatacatcgtcatggagctcgtcaccggtggcgaactcttcgacaaaatcgcctcgcgtggaaggctgaaagaggatgacgcaaggaagtacttccagcagctgatcaacgctgtcgattactgccatagccgaggcgtctaccaccgcgatctcaagcctgaaaatctcctgcttgatgctagcggcacgctcaaggtttcggattttggactgagcgcactatctcaacaagtccgagaggatggtctgctgcacacaacctgtggaactcccaactatgttgctcccgaggttataaacaataagggctatgatggagctaaggctgatctgtggtcatgtggagtgattctctttgtcctcatggcggggtacctcccatttgaagattcgaacctgatgtcgctctacaagaagatcttcaaagcggatttcagttgcccgtcctggttctccacaagcgcaaagaagctcatcaagaagatacttgaacctaatgctaacaatagaataactattgcagagctcattaacaacgagtggttcaagaaggggtatcagcctcccagatttgaaacagcagatgttaatctggatgacgtgaactccatcttcgatgaatccggggagccagcacagcttgttgttgagaggagagaagaaaggccatcagtgatgaacgctttcgagttaatctctacgtctcagggcctcaatctcgggacgctcttcgagaagcaaacgggttctgttaagcgagaaacaaggtttgcgtcaaggcttcctgcaaatgagatactgtcgaagatcgaagcagcagcaggacccatgggcttcaacgttcagaagcgcaactataagctgaagctgcaaggggagaaccctggaaggaaaggtcagctggccatcgcaacagaggttttcgaggtcacgccttccctgtacatggttgagctgcgcaagtccaacggcgacacccttgaattccacaagttctaccacaacatctcaaatggactgaaggacgtgatgtggaagccggagagcggcatcgtggaaggcgacgaggcgcggcaaaggaggtccccgtga

SEQ ID NO: 396 - protein, 449 aa, Zea mays
MSASVGRTRVGRYELGRTLGEGTFAKVKFARNVETGENVAIKILDKEKVLKHKMIAQIKREISTMKLIRHPNVIRMYEVMASKTKIYIVMELVTGGELFDKIASRGRLKEDDARKYFQQLINAVDYCHSRGVYHRDLKPENLLLDASGTLKVSDFGLSALSQQVREDGLLHTTCGTPNYVAPEVINNKGYDGAKADLWSCGVILFVLMAGYLPFEDSNLMSLYKKIFKADFSCPSWFSTSAKKLIKKILEPNANNRITIAELINNEWFKKGYQPPRFETADVNLDDVNSIFDESGEPAQLVVERREERPSVMNAFELISTSQGLNLGTLFEKQTGSVKRETRFASRLPANEILSKIEAAAGPMGFNVQKRNYKLKLQGENPGRKGQLAIATEVFEVTPSLYMVELRKSNGDTLEFHKFYHNISNGLKDVMWKPESGIVEGDEARQRRSP

SEQ ID NO: 397 - DNA, 777 bp, Zea mays
  CDS (1)..(777)
atgctaccgtccgacaccccaagcaccagcgcctcggaggcgaccatggctgtcggaaagaacaagaggatctccaagggaaagaagggtggcaagaaaaagattctcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggtttgaatgtgctcacaaacttttggggtatgaattttaccactgataaactgagatccctagtgaagaagtggcagacattaatcgaagcccatgttgatgtcaagacaaccgacaactacatgttgcgtttgttctgcatcggcttcacgaagaggcgcccaaaccaggtcaagagaacctgctatgctcaggcatcccagatccgtcagatccgccgtaagatggttgagattatgatcaaccaggcttctacatgtgacctgaaagaacttgtttcgaagttcattccagaagttattggtaaggagattgagaagtctacctccagcatcttcccacttcaaaacgtcttcatccgcaaggtgaagatactcaaggcccccaagttcgatcttgggaagctcatggaggttcatggcgactacaaagaggatgttggtgtgaagctttga

SEQ ID NO: 398 - protein, 258 aa, Zea mays
MLPSDTPSTSASEATMAVGKNKRISKGKKGGKKKILDPFSKKDWYDIKAPSVFSVRNIGKTLVSRTQGTRIASEGLKHRVFEVCLADLQGDEDQAYRKIRLRAEDVQGLNVLTNFWGMNFTTDKLRSLVKKWQTLIEAHVDVKTTDNYMLRLFCIGFTKRRPNQVKRTCYAQASQIRQIRRKMVEIMINQASTCDLKELVSKFIPEVIGKEIEKSTSSIFPLQNVFIRKVKILKAPKFDLGKLMEVHGDYKEDVGVKL

SEQ ID NO: 399 - DNA, 456 bp, Zea mays
  CDS (1)..(456)
atgtgtacctgcatctcgacctcaccggcgtccggcggtggtatcacgatggtggcgttgctgggccggcggatcggggtggctgcggcagctgccgcgttcatcgccctcgtggcgttcggatccgcctcatcctcgcccaagtccttcgtgaagtccaccgtctccgcccacgacgtcgtcatcttctccaagtcatactgcccgtactgcaaaagagcaaaggccgtgtttaaggagcttgagttgaagaaagagccatatgttgtggagcttgatcagcgagaggatggctcagagattcaggatgccttacttgagatagttggcaggcgtactgtccctcaagtttttgtccatggaaagcacctgggtggttctgacgatactgttgactcctacgaaagtggaaaactggctagacttctaaacatcggagtcaaggacgacctttga

SEQ ID NO: 400 - protein, 151 aa, Zea mays
MCTCISTSPASGGGITMVALLGRRIGVAAAAAAFIALVAFGSASSSPKSFVKSTVSAHDVVIFSKSYCPYCKRAKAVFKELELKKEPYVVELDQREDGSEIQDALLEIVGRRTVPQVFVHGKHLGGSDDTVDSYESGKLARLLNIGVKDDL

SEQ ID NO: 401 - DNA, 543 bp, Zea mays
  CDS (1)..(543)
atggattcgctgcgcagcgtgttggagtcgattcaggcgatgcagatccgccccgtggtcgtccaattcttcaccctagggatgatcctaacttcggcattgatcctatggaaaggattggtcgtcgtaacagggagtgagtcgccggttgtggtggttctatctggaagcatggagcctgggtttcgaaagggtgatgtcctgtttctgcacatgaataaggaccctgtccgcacaggagacatagttgttttcaatgtcgagggccgtgatattccaattgtccatcgtgtgatcaaggttcatgaacgccatgatacggtggactctgacattctcacgaaaggtgacaataatcccggggatgaccgagtcctgtacgcacatgggcagctttggctgcagcgacagcacatcattggacgggctgttggctatctgccttatgctgggtggcttacaatcgtcatgacggagaaaccagtcctcaagtatctgctaattggtgcactggggctaaaaaaggtagcatccaaggagtga

SEQ ID NO: 402 - protein, 180 aa, Zea mays
MDSLRSVLESIQAMQIRPVVVQFFTLGMILTSALILWKGLVVVTGSESPVVVVLSGSMEPGFRKGDVLFLHMNKDPVRTGDIVVFNVEGRDIPIVHRVIKVHERHDTVDSDILTKGDNNPGDDRVLYAHGQLWLQRQHIIGRAVGYLPYAGWLTIVMTEKPVLKYLLIGALGLKKVASKE

SEQ ID NO: 403 - DNA, 480 bp, Zea mays
  CDS (1)..(480)
atggcgacgcactactcctgcctcacgccgccgctcaaaccgcagaagagagaagagaagcacgcccaaaaattccgaggttttcacctcttggagcgcaccaacaccacccggagaccggagcgactcgccaccggcgcggaaaaggagggcggaggctcgatggcggatgagaatcaggctggaaagaaagaggaggaggaatttagcacaggccctctgtcagtcctaatgatgagtgttaagaacaacacccaggtcctcatcaattgccgcaacaacaagaagctgcttggccgtgttcgtgcttttgatcgccactgtaacatggtgctcgagaacgtgcgtgagatgtggacagagatccccaagactggcaagggcaaaaagaaggctctgcctgtgaacaaggatagattcatcagtaagatgttcctcaggggcgactcggtcatcatagtgctgaggaacccgaagtga

SEQ ID NO: 404 - protein, 159 aa, Zea mays
MATHYSCLTPPLKPQKREEKHAQKFRGFHLLERTNTTRRPERLATGAEKEGGGSMADENQAGKKEEEEFSTGPLSVLMMSVKNNTQVLINCRNNKKLLGRVRAFDRHCNMVLENVREMWTEIPKTGKGKKKALPVNKDRFISKMFLRGDSVIIVLRNPK

SEQ ID NO: 405 - DNA, 603 bp, Zea mays
  CDS (1)..(603)
atgccctcccaacatccctcccaaaccaccatctttttcatcaggagcatatttcttaagatcacgcatggcgactggaaggaagccatgcattgctttaaagggaagatgccggcggggcacgggctgcggtcgcggacccgcgacctgttcgcgcggcccttccgcaagaaggggtacatcccgctcaccacgtacctgcgcacctacaagatcggcgactacgtcgacgtcaaggttaacggcgccgtgcacaagggcatgccgcacaagttctaccacggccgcaccgggagcgtctggaacgtcaccaagcgcgccatcggcgtcgagatcaacaagcaggttaatggccgcatcatcaggaagcggatccatgtccgcgtggagcatgtgcagccctcccgttgcacagaggagttccgcttgaggaaagccaagaatgaccagctcaaggcggatgccaaggcccgcggtgaggtgatcagcaccaagaggcagcctgtgggacccaaacctggcttcatggtcgagggtgctacactcgagacagtcactcctattccttatgatgtggtcaacgatctcaagggcggttactga

SEQ ID NO: 406 - protein, 200 aa, Zea mays
MPSQHPSQTTIFFIRSIFLKITHGDWKEAMHCFKGKMPAGHGLRSRTRDLFARPFRKKGYIPLTTYLRTYKIGDYVDVKVNGAVHKGMPHKFYHGRTGSVWNVTKRAIGVEINKQVNGRIIRKRIHVRVEHVQPSRCTEEFRLRKAKNDQLKADAKARGEVISTKRQPVGPKPGFMVEGATLETVTPIPYDVVNDLKGGY

SEQ ID NO: 407 - DNA, 1080 bp, Zea mays
  CDS (1)..(1080)
atggcacgacgtcgaaatcctccaataccccaccctacgaatcttccaacccctccgacgatgccttccgcgccggcgctcgtccccgcgtgcgacatgcaggagccgttgctggcggagtcgtccgaccgcttctccatgttcccgatccggtacccgcagatttgggagttctacaagaaggcggtggcgtccttctggactgccgaggaggtggacctctccgcggacgcgcgccactgggacgcggccctctcccccgacgagcgccacttcatctcccacgtgctcgccttcttcgccgcctccgacggcatcgtgctcgagaacctcgcctcccgcttcatgtccgatgtccaggtcgccgaggcgcgcgccttttacggcttccaaatcgccatcgagaacatccactcggagatgtactcgctgctgctcgagacctacatccgcgatggcaccgagaaggaccgcctcttccgcgccatcgaaaccgtccccgccgtacgccgcaaggccgactgggccatgcgctggatcgacggcggggagcgctttgccgagcgcctcgttgccttcgcctgcgtcgagggcatcttcttctcgggctccttctgcgccatcttctggctcaagaagcgcggcctcatgccgggcctcactttctctaatgagctcatctcccgggacgagggcctccactgcgacttcgcctgcctcctttatgacctccttcggggcaagctcgatgagtcccgcgtccgcgagatcgttgccgacgccgtcgacatcgagcgtgagttcgtttgcgacgcgctccccgtcgcgctggtcggaatgaacggcgggctcatgagccagtacatcgagttcgtcgccgaccgcctgctcatggcgctggggcacaggaagatgtacaacgtcgccaaccccttcgactggatggagctcatttccctgcagggcaagactaacttctttgagaagcgcgtcggggagtaccagaaggcgtccgtaatgtccagcctcaacggcggcgctgctgcaaaccataccttcagcatcgacgaggacttctga

SEQ ID NO: 408 - protein, 359 aa, Zea mays
MARRRNPPIPHPTNLPTPPTMPSAPALVPACDMQEPLLAESSDRFSMFPIRYPQIWEFYKKAVASFWTAEEVDLSADARHWDAALSPDERHFISHVLAFFAASDGIVLENLASRFMSDVQVAEARAFYGFQIAIENIHSEMYSLLLETYIRDGTEKDRLFRAIETVPAVRRKADWAMRWIDGGERFAERLVAFACVEGIFFSGSFCAIFWLKKRGLMPGLTFSNELISRDEGLHCDFACLLYDLLRGKLDESRVREIVADAVDIEREFVCDALPVALVGMNGGLMSQYIEFVADRLLMALGHRKMYNVANPFDWMELISLQGKTNFFEKRVGEYQKASVMSSLNGGAAANHTFSIDEDF

SEQ ID NO: 409 - DNA, 438 bp, Zea mays
  CDS (1)..(438): n means a or g or c or t/u
atgnncgacgaccagatcgccgagttcaaggaggccttcagcctcttcgacaaggacggggatggttgcatcacgaccaaggagctgggcactgtcatgcgctcgctggggcaaaatcctacagaggctgagctccaggacatgatcaacgaggtcgatgctgatggcaacggcaccatcgatttcccagagtttctcaaccttatggctcgcaagatgaaggacaccgactctgaggaagagctcaaggaggccttccgtgtgtttgacaaggaccagaacggcttcatctcggccgccgagctccgccatgtcatgacaaatcttggtgagaagctaactgatgaggaggtggacgagatgatccgtgaggctgatgtcgatggtgatggccagatcaactacgaggagtttgtcaaggtcatgatggccaagtga

SEQ ID NO: 410 - protein, 145 aa, Zea mays
  misc_feature (2)..(2): Xaa can be any amino acid
MXDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 411 - DNA, 429 bp, Zea mays
  CDS (1)..(429)
atgatccgcttcatcctgctgcagaaccggcaggggaagactcgactggccaagtattacgtcccgctcgaggactcggaaaagcacaaggttgaatacgaggtacaccggctcgtggtcaatcgggaccctaagttcaccaacttcgtcgagtttcgcacacacaaagttatctacaggagatatgctggactgtttttttcaatatgtgtggacataactgataatgaattggcatacttggaatgcattcacttgtttgtcgagatattggaccatttctttagcaatgtttgtgagctcgatttagtgtttaattttcacaaggtttacctgatactagatgaatttattcttgctggggagctgcaagaaacaagcaaaaaggcaataattgagcgaatgggtgaactggagaagctggaatga

SEQ ID NO: 412 - protein, 142 aa, Zea mays
MIRFILLQNRQGKTRLAKYYVPLEDSEKHKVEYEVHRLVVNRDPKFTNFVEFRTHKVIYRRYAGLFFSICVDITDNELAYLECIHLFVEILDHFFSNVCELDLVFNFHKVYLILDEFILAGELQETSKKAIIERMGELEKLE

SEQ ID NO: 413 - DNA, 855 bp, Zea mays
  CDS (1)..(855): n means a or g or c or t/u
atgtcgcttcgacgatttcgtccggagcgcacgtcagatcaggtgcgccgncgcccccctcgcctaagctgcgacgaccatccatcgaacaggtaccactcgccgctgcccctcctttcccttcctgctgcgccgtggaaccctctaagcgatttggatttggatctcacctcgctccttcccgtggcgatacgactcgccgtgactttgatccgtggcggtggctctgcgggtgcaggaaggatgacgggctccatggatctcccggccaagggcgggttcagcttcgacctgtgccgccggaacaacatgctggagaagaacgggctcaaggtcccgggattcaggaagaccgggacaaccatcgtcggcctcgtctttcaggatggggttgttcttggggcagacacaagggcaactgagggccccatagttgctgataagaactgtgagaaaatccactttatggcaccgaatatatactgctgtggagcaggaactgctgcggacacggaggccgttacagatatggtgagctcccagctacagcttcaccgttatgcaacgggccgcgaatcaagagttgtaactgctcttacactactgaaganacacctcttcaagtatcaaggccatgtcagtgctgcccttgttcttggtggagtggattgtactgggccacatttacacactgtttatccacaggggtccaangatactcttcctttgccaccatgggctctggttctcttgctgcaatgtcagtgtttgaatcgaagtacaaagaagaccttactagggaggagggaatacagattgtgtgcgaagcaatctgtgctggtattttcaatgtga

SEQ ID NO: 414 - protein, 284 aa, Zea mays
  misc_feature (204)..(204): Xaa can be Lys or Thr or Arg or Ile
  misc_feature (238)..(238): Xaa can be Lys or Asn
MSLRRFRPERTSDQVRRRPPRLSCDDHPSNRYHSPLPLLSLPAAPWNPLSDLDLDLTSLLPVAIRLAVTLIRGGGSAGAGRMTGSMDLPAKGGFSFDLCRRNNMLEKNGLKVPGFRKTGTTIVGLVFQDGVVLGADTRATEGPIVADKNCEKIHFMAPNIYCCGAGTAADTEAVTDMVSSQLQLHRYATGRESRVVTALTLLKXHLFKYQGHVSAALVLGGVDCTGPHLHTVYPQGSXDTLPLPPWALVLLLQCQCLNRSTKKTLLGRREYRLCAKQSVLVFSM

SEQ ID NO: 415 - DNA, 696 bp, Zea mays
  CDS (1)..(696)
atgcatacacaggcacagatggcagagcataaagggaacgttctcttgcacaagtatgagatggggaaattgcttggccaaggcacctttgccaaggtttaccatgctcgtaacacggcgacttcagaaagtgtcgcgatcaaagtgattgacaaggagaaggttatgaaggttggtctcattgatcaaatccagcgagagatttctgcgatgaagctcgtcaggcacccaaacgtcgtgcagcttaacgaggtcatagccaccaagaccaaaatatacttcgtgttggagtatgttaaaggcggggagctcttggctaaagtaaagcgaggaaggcttaaggaagatgcagcgaggaagtacttccaacagctgatctgtgcggtggacttctgtcacagcaggggtgtctatcatcgagatttgaagccagaaaatcttttgctcgatgagaatagcaacctgaaggtatcagattttggtctaagcgcacttgctgaatgccatagacaagacggcctgctccacacgacttgtggcacgcctgcttatgttgccccagaggagattaacagaaagggttatgatggtgcaaaggctgacatatggtcttgtggggtcatcctatttgtgctattggctggttatcttccgttccatgataagaacttgatggacatgtataagaagatttga

SEQ ID NO: 416 - protein, 231 aa, Zea mays
MHTQAQMAEHKGNVLLHKYEMGKLLGQGTFAKVYHARNTATSESVAIKVIDKEKVMKVGLIDQIQREISAMKLVRHPNVVQLNEVIATKTKIYFVLEYVKGGELLAKVKRGRLKEDAARKYFQQLICAVDFCHSRGVYHRDLKPENLLLDENSNLKVSDFGLSALAECHRQDGLLHTTCGTPAYVAPEEINRKGYDGAKADIWSCGVILFVLLAGYLPFHDKNLMDMYKKI

SEQ ID NO: 417 - DNA, 513 bp, Zea mays
  CDS (1)..(513): n means a or g or c or t/u
atgnttgtgttggtcccgggaattcggccattatggccggggctccactcgcatcagagcggcgccggcctacaaccgttttcgtgctcacacacccaaaccttagtcgcgatcaggccccaaggactcgagatgaagtcgagggcacggtccaccgccggcgactccaggctctcggtgaggaagaccaaggctgagaaggacccaaacaagcccaagaggcctccgagcgcgttcttcgtcttcatggaggagttcaggaaggactacaaggagaagcaccccaatgtgaagcaagtctccctgattggcaaggctggtggtgacaagtggaagtccctgtctgatgccgagaaggctccctacgtgtctaaggcagagaagctcaaggctgagtacaccaagaagatcgacgcttacaacaacaagcagtctggagaccccacggcgtctggtgattccgacaagtccaagtccgaggtgaacgacgaggacgaggagggtgacgagtga

SEQ ID NO: 418 - protein, 170 aa, Zea mays
  misc_feature (2)..(2): Xaa can be Ile or Leu or Val or Phe
MXVLVPGIRPLWPGLHSHQSGAGLQPFSCSHTQTLVAIRPQGLEMKSRARSTAGDSRLSVRKTKAEKDPNKPKRPPSAFFVFMEEFRKDYKEKHPNVKQVSLIGKAGGDKWKSLSDAEKAPYVSKAEKLKAEYTKKIDAYNNKQSGDPTASGDSDKSKSEVNDEDEEGDE

SEQ ID NO: 419 - DNA, 657 bp, Zea mays
  CDS (1)..(657)
atgtttaagcttgggaagaagatcgggagcggatctttcggcgagctctatctcggcgtcaacatacagagcggcgaggaggtggctatcaagttggaatctgtaaaatcaaggcatcctcagcttcattatgagtcgaaactatacatgcttctccaagggggaactggaattcctcatttgaaatggtttggggtggatggggagtacaatgtcatggtcattgatcttcttggtccaagtctggaagacgtattcaaccagtgcaacagaaagttttctcttaaaacagtacttatgctagctgatcagatgataactagggtagagtacatgcacacgagggggttccttcatcgtgatatcaagccagacaatttccttgtgggcttaggtcgtaaagcaaatcaggtttatatcattgactatggccttgcgaagaagtatcgggacctccaaactcataaacacattccatacagggagaacaaaaacctcacaggaactgcacgatatgctagtgtaaacacccatcttggagtagaacaaagcagaagagatgacttagagtctcttggttatgtgctgatgtacttcttaagaggaagccttccttggcaaggcctgaaagctggaacaaaaaaacaaaagtattga

SEQ ID NO: 420 - protein, 218 aa, Zea mays
MFKLGKKIGSGSFGELYLGVNIQSGEEVAIKLESVKSRHPQLHYESKLYMLLQGGTGIPHLKWFGVDGEYNVMVIDLLGPSLEDVFNQCNRKFSLKTVLMLADQMITRVEYMHTRGFLHRDIKPDNFLVGLGRKANQVYIIDYGLAKKYRDLQTHKHIPYRENKNLTGTARYASVNTHLGVEQSRRDDLESLGYVLMYFLRGSLPWQGLKAGTKKQKY

SEQ ID NO: 421 - DNA, 426 bp, Zea mays
  CDS (1)..(426)
atgaagcatcaggacctcgtccgctgtgtcttccaattactctctgcaaggcccgagagcgcgagcaattttgtcaaggtggactccatctttggcccgggaacaaaaatggtctacaagcatttggccacactatactttgtttttgtctttgatagctctgagaacgagcttgccatgctcgacctcgtacaagtgtttgttgaaacattggacagatgcttcaaggatgtatgcgagcttgacatcgtatttaacttcaacaagctgcacaccattttggatgagatgatatcggggggacaggtgatcgaaacaagttcagaacagataatgaaatctgtggaagagattgaaaggctggagaaacaatcgagcacaaccagcttcatacccaagtcgattacagagcgttttacccgttga

SEQ ID NO: 422 - protein, 141 aa, Zea mays
MKHQDLVRCVFQLLSARPESASNFVKVDSIFGPGTKMVYKHLATLYFVFVFDSSENELAMLDLVQVFVETLDRCFKDVCELDIVFNFNKLHTILDEMISGGQVIETSSEQIMKSVEEIERLEKQSSTTSFIPKSITERFTR

SEQ ID NO: 423 - DNA, 348 bp, Zea mays
  CDS (1)..(348)
atgtctgatctcgacgtccagcttccatctgcttttgatccgtttgcagaggcaaatgctgaggactccagtgctggtgctggatcaaaggactatgtgcacgtgcgtattcagcagcgcaacggaaggaagagtctgacaactgttcagggcttgaagaaagagtacagctacaacaagatcctcaaggatctcaaaaaagagttctgctgcaatggtactgtagtccaggatccagagctaggccaggtcattcaactgcaaggtgatcagcgtaaaaatgtcgctacttttctagtccaggccggaatcgtgaaaaaagatagcatcaagattcacggattttga

SEQ ID NO: 424 - protein, 115 aa, Zea mays
MSDLDVQLPSAFDPFAEANAEDSSAGAGSKDYVHVRIQQRNGRKSLTTVQGLKKEYSYNKILKDLKKEFCCNGTVVQDPELGQVIQLQGDQRKNVATFLVQAGIVKKDSIKIHGF

SEQ ID NO: 425 - DNA, 663 bp, Zea mays
  CDS (1)..(663)
atgcacgagccgatcgagctagatctccaggactcacctccccaaccgtttgcctccgtctcgcgtgacttcattcccagcggccggcggcgacctccacgtggtgccattcgccggcaacgagcacccgcccaccaggatccaggtttgtgctgcgagagcgcctatccattcaccatgattaatttcgtgctcctgatcagccgccagggcaaggtgaggctcaccaagtggtattctccttacacccagaaagagaggaccaaggtcattcgcgaactcagtggactcattcttacacgagggcccaaactctgcaattttgttgagtggagaggttacaaggtcgtataccggaggtatgctagcctgtatttctgcatgtgcattgatgccgaggacaatgagcttgaagtccttgagatcatccatcatttcgtcgagatactggaccgctattttggcagtgtatgtgagttggatttgatattcaattttcataaggcctactacatactggatgagattctcatcgctggtgaacttcaagaatctagcaagaagaatgttgcaagacttattgctgcacaggattcattggtcgaagctgctaaagaggaagccagctccataagtaacattattgctcaggctacaaaatga

SEQ ID NO: 426 - protein, 220 aa, Zea mays
MHEPIELDLQDSPPQPFASVSRDFIPSGRRRPPRGAIRRQRAPAHQDPGLCCESAYPFTMINFVLLISRQGKVRLTKWYSPYTQKERTKVIRELSGLILTRGPKLCNFVEWRGYKVVYRRYASLYFCMCIDAEDNELEVLEIIHHFVEILDRYFGSVCELDLIFNFHKAYYILDEILIAGELQESSKKNVARLIAAQDSLVEAAKEEASSISNIIAQATK

SEQ ID NO: 427 - DNA, 1476 bp, Zea mays
  CDS (1)..(1476)
atgacgccgttacgctgcccgactccggcgtcgtccccacagtccgcctcaaacgacccaaccaccgctcaagccttaacccaacatttatctgtatcccgtggcaaggagcatctgcgcgtcacatccgcgatcgcgcgctctacgtcgcctcccgccgccgccgcacggccgcgacggatgctcggccaccgcttccctaccgccctccgcctcccacatggtctgctgctgaggaggagcatcatggcccgccgcggcctgaccatcatggccggcggcgaggcggagggtccgctcgcgggtttcttcgactacatggagcggctacgcaactacgagcgctcgggcgtgccgcgcggcgccggcaccgactccgacgacgggttcgacctcggacgcatgcgccggctcctccgccggctcggcgacccccacacccacttcccggctgtgcatatcgccggcaccaaggggaaaggttctactgctgcattcctgtccaatatcatgagggcccaaggctacaatgtaggctgttattctagtccacatcttctaacaatacgtgaacggatttctgttggaaatgatggaggccctgttccagtacgactgttgagtgatctttttgacgaggctaagaaagccattgatgaagcaatagaatcggaaaatggatccctgacacattttgaggtttttactgctctctcatttcttctattctcccaacagaatgttgacattgccatcattgaagcaggtcttggtggagctagggatgcaacaaatgttattcgaagtactgaattagcagcatccgtcataacaacagtagggagggaacatctggttgcattgggtggctccctgcaaagcatagcaatagcaaagtctggaatcatcaaacaaggacaaccagttgtgattggtggaccattttcagaagatattgagcaaattattcgtgacagggcattcttgacacaatctcccgtgatatctgcttgtggtcatggcatcaagagctttacaaaatgcatagattgggataatggtaagccgtatcaacgctgttacatcagcattaagatttcaagggatgtacccttgtcgattgaaatgcatgacataaacctccagctgctgggagatcatcaacgtcagaatgctgtcacagctgcttgcgcagctctctgtctctgtagtcaaggatgggatatctctgacgcttctatccaagccggcttagaggagacccaacttcctggcaggagccagtttctcacagcagaggaagcctcggcacttgggttcgatagcgcatccactgtactaattgatggagctcatactgaggaatctgcaaaggccttatcaggtgtgatcaaaactgtcagaccagaagggcctctagcgcttgttgtcggaatggctagtgacaaggagcatcttgcgtttgccgagcagtga

SEQ ID NO: 428 - protein, 491 aa, Zea mays
MTPLRCPTPASSPQSASNDPTTAQALTQHLSVSRGKEHLRVTSAIARSTSPPAAAARPRRMLGHRFPTALRLPHGLLLRRSIMARRGLTIMAGGEAEGPLAGFFDYMERLRNYERSGVPRGAGTDSDDGFDLGRMRRLLRRLGDPHTHFPAVHIAGTKGKGSTAAFLSNIMRAQGYNVGCYSSPHLLTIRERISVGNDGGPVPVRLLSDLFDEAKKAIDEAIESENGSLTHFEVFTALSFLLFSQQNVDIAIIEAGLGGARDATNVIRSTELAASVITTVGREHLVALGGSLQSIAIAKSGIIKQGQPVVIGGPFSEDIEQIIRDRAFLTQSPVISACGHGIKSFTKCIDWDNGKPYQRCYISIKISRDVPLSIEMHDINLQLLGDHQRQNAVTAACAALCLCSQGWDISDASIQAGLEETQLPGRSQFLTAEEASALGFDSASTVLIDGAHTEESAKALSGVIKTVRPEGPLALVVGMASDKEHLAFAEQ

SEQ ID NO: 429 - DNA, 783 bp, Zea mays
  CDS (1)..(783): n means a or g or c or t/u
atgcaaaaagggtaccggaagcggcgaaagcctcgccccccgccgctctcgcatcgtctccggagcgcacgtcagatcaggtgcgccgcgcccccctcgcctaagctgcngacgaccatccatcgaacaggaaggatgacgggctccatggatctcccggccaagggcgggttcagcttcgacctgtgccgccggaacaacatgctggagaagaacgggctcaaggtcccgggattcaggaagaccgggacaaccatcgtcggcctcgtctttcaggatggggttgttcttggggcagacacaagggcaactgagggccccatagttgctgataagaactgtgagaaaatccactttatggcaccgaatatatactgctgtggagcaggaactgctgcggacacggaggccgttacagatatggtgagctcccagctacagcttcaccgttatgcaacgggccgcgaatcaagagttgtaactgctcttacactactgaagtcacacctcttcaagtatcaaggccatgtcagtgctgcccttgttcttggtggagtggattgtactgggccacatttacacactgtttatccacacgggtccactgatactcttccttttgccaccatgggctctggttctcttgctgcaatgtcagtgtttgaatcgaagtacaaagaaggccttactagggaggagggaatacagattgtgtgcgaagcaatctgtgctggtattttcaatgacttgngtagtgggagcaacgtggacgtctgcgtgtga

SEQ ID NO: 430 - protein, 260 aa, Zea mays
  misc_feature (37)..(37): Xaa can be Arg or Gln or Leu or Pro
  misc_feature (251)..(251): Xaa can be Arg or Cys or Ser or Gly
MQKGYRKRRKPRPPPLSHRLRSARQIRCAAPPSPKLXTTIHRTGRMTGSMDLPAKGGFSFDLCRRNNMLEKNGLKVPGFRKTGTTIVGLVFQDGVVLGADTRATEGPIVADKNCEKIHFMAPNIYCCGAGTAADTEAVTDMVSSQLQLHRYATGRESRVVTALTLLKSHLFKYQGHVSAALVLGGVDCTGPHLHTVYPHGSTDTLPFATMGSGSLAAMSVFESKYKEGLTREEGIQIVCEAICAGIFNDLXSGSNVDVCV

SEQ ID NO: 431 - DNA, 1920 bp, Zea mays
  CDS (1)..(1920)
atgacggacggtcaccacttcaacaacatcctcctcggagggcgcggcggcacaaaccctggtcagtttaaagtgcattctggtggacttgcatggaagagacaaggtggaggaaagaccattgagatcgacaaagctgatgtaactgcagttacttggatgaaagtccccagagcatatcagcttggagtcaggattaaggctggcctgttctacagatttattggcttccgtgaacaggatgtaagcaacttgaccaacttcatacaaaagaatatgggtgtcacaccagatgaaaaacagctttctgttagtggccacaattggggagggattgatatagatggaaacatgctaacctttatggttggttcaaagcaagcatttgaggtgtccctaccagatgttgcacaaacccagatgcaaggaaaaacagatgttctcttagagcttcatgttgatgatactactggagccaatgagaaagactccctcatggatttgagttttcatgtgcctacttcgaatactcagtttgttggggatgagagtcgccctccggctcatattttatgggagaccatattgaaatttgctgatgttggttcttctgaagaaccagttgtcacatttgaaggaattgcgatccttacaccaagaggacgttatagtgttgaacttcatctgtcatttctgcgactccaaggacaagctaacgattttaaaatccaatacagcagtattgttcgcctctttcttttgccaaagtcaaacaatcctcatacatttgttgttatcactcttgacccaccaatccgtaaaggacaaacattgtatcctcacattgttattcagtttgagacagaggcagtagtggaaagagatctggcattgagtaaagagctgttggttgaaaaatacaaggacaggctcgaggaatcttacaagggtctaatacatgaggtatttaccaaagttcttcgtggtctatctggtgctaaagtcacaaggccaggttctttcagaagttgccaagatggatatgcagttaaatcatctctcaaagctgaagatggactgttgtatccacttgaaaagggtttctttttcctgccaaagccacctacactcattcttcatgaggagattgagtttgttgagtttgaacgtcatggtgctgggggtgccagtatatcatctcactattttgacctccttgtcaaactgaaaaatgaccaagagcatctcttcagaaacattcaaaggaatgaataccacaacctcttcaatttcatcaatggaaagaacattaaaataatgaaccttggaggagatggtcaaggtgcaagtggtgtagttacagatgttctacgagacactgatgatgatgctgttgatccacatctagagcgtattaagaatcaggccggggatgaggaaagcgatgaagaggatgaagattttgttgcagacaaggatgatagtggatctcctactgatgactcaggtgatgaggaatcagatgctagtgatagtggtggtgaaaaggagaaatcatccaagaaggaagcaagcagttcaaagccagttcagaaaagaaagcataagggcagggatgacgaaggacaagagaagaaaaagccaaagaagaaaaaagatccgaatgctccgaaacgagccatgaccccgttcatgtatttctcaatggctgagcgaggaaacatgaagagcagcaacccagatttgcctacgactgagatcgcaaagaagcttggggagatgtggcaaaagatgtcaggcgaagagaaacagccttacatccagcaggcccaggtcgacaagaaacgttatgaaaaagaatccgctgtctatcgcggtgaagctacagtcgatgtggattctgggaacgagtctgactga

SEQ ID NO: 432 - protein, 639 aa, Zea mays
MTDGHHFNNILLGGRGGTNPGQFKVHSGGLAWKRQGGGKTIEIDKADVTAVTWMKVPRAYQLGVRIKAGLFYRFIGFREQDVSNLTNFIQKNMGVTPDEKQLSVSGHNWGGIDIDGNMLTFMVGSKQAFEVSLPDVAQTQMQGKTDVLLELHVDDTTGANEKDSLMDLSFHVPTSNTQFVGDESRPPAHILWETILKFADVGSSEEPVVTFEGIAILTPRGRYSVELHLSFLRLQGQANDFKIQYSSIVRLFLLPKSNNPHTFVVITLDPPIRKGQTLYPHIVIQFETEAVVERDLALSKELLVEKYKDRLEESYKGLIHEVFTKVLRGLSGAKVTRPGSFRSCQDGYAVKSSLKAEDGLLYPLEKGFFFLPKPPTLILHEEIEFVEFERHGAGGASISSHYFDLLVKLKNDQEHLFRNIQRNEYHNLFNFINGKNIKIMNLGGDGQGASGVVTDVLRDTDDDAVDPHLERIKNQAGDEESDEEDEDFVADKDDSGSPTDDSGDEESDASDSGGEKEKSSKKEASSSKPVQKRKHKGRDDEGQEKKKPKKKKDPNAPKRAMTPFMYFSMAERGNMKSSNPDLPTTEIAKKLGEMWQKMSGEEKQPYIQQAQVDKKRYEKESAVYRGEATVDVDSGNESD

SEQ ID NO: 433 - DNA, 543 bp, Zea mays
  CDS (1)..(543): n means a or g or c or t/u
atggattcgctgcgcagcgtgttggagtcgattcaggcgatgcagatccgcnccgtggtcgcccaaatcatcaccctagggatgatcctaacttcggcattgatcctatggaaaggattggtcgtcgtaacagggagtgagtcgccggttgtggtggttctatctggaagcatggagcctgggtttcgaaagggtgatgtcctgtttctgcacatgaataaggaccctgtccgcacaggagacatagttgttttcaatgtcgagggccgtgatattccaattgtccatcgtgtgatcaaggttcatgaacgccatgatacggtggactctgacattctcacgaaaggtgacaataatcccggggatgaccgagtcctgtacgcacatgggcagctttggctgcagcgacagcacatcattggacgggctgttggctatctgccttatgctgggtggcttacaatcgtcatgacggagaaaccagtcctcaagtatctgctaattggtgcactggggctaaaaaaggtagcatccaaggagtga

SEQ ID NO: 434 - protein, 180 aa, Zea mays
  misc_feature (18)..(18): Xaa can be Thr or Pro or Ala or Ser
MDSLRSVLESIQAMQIRXVVAQIITLGMILTSALILWKGLVVVTGSESPVVVVLSGSMEPGFRKGDVLFLHMNKDPVRTGDIVVFNVEGRDIPIVHRVIKVHERHDTVDSDILTKGDNNPGDDRVLYAHGQLWLQRQHIIGRAVGYLPYAGWLTIVMTEKPVLKYLLIGALGLKKVASKE

SEQ ID NO: 435 - DNA, 1590 bp, Zea mays
  CDS (1)..(1590)
atgagcagctgcctgcctgctccgaggcgccacccagctcttcctcgccccagcagccgcttcccgagatccttttcactttcaccaccagggtacatagaccgcatctgcgggctctgcgctcctcggactcgatttgttggttcatccatccagctgccgccggacgtcgatcagctacctatcttgaaaccacaggaccgagcgtggaaactcccggaccggacattccattttccattccgaaggggggtgagaaggcggggaatgagtacaaccaaggtgaagagacgtgtgggcaagtatgagctcggccggaccataggcgagggcaccttcgcgaaggtcaggttcgcgagggacacggtcaccggcgaggccgtggccattaagatcctggacaaggagaaggtcctcaggcacaagatggttgagcagatcaagcgggagatctcgacgatgaagctgatcaagcaccctaacgtcgtccgcatatacgaggtgatgggaagtaaaacaaagatctacattgtgttagaattcgctaccggtggcgagctctttgatacaattgttaaccatggtcgaatgagggaagacgaggcaaggaggtacttccaacagttaatcaatgcagttgattattgtcatagcaggggtgtgtaccaccgggatttaaaacctgaaaatttgctgcttgattcatatggtaacctgaaggtctctgactttgggctcagcgcgctatctcagcaaatcaaggatgatggactgctgcacacaacttgtgggactccaaactatgttgcaccagaggtccttgaagatcaaggctacgatggagcaatggctgatctgtggtcatgtggagttatcctgtttgttctgctagcagggtatttgccgtttgaggaatctaatctcatgactttgtataagaaaatatcaaatgcagaatttacatttccaccatggacatcttttcctgccaagaggttgttaacaagaatccttgatccaaatccaatgacgagaataacaatcccagaaatattagaggatgagtggttcaaaaagggctacaagcgcccagaatttgatgaacaatatgacaccacattggatgatgtggatgccgtcttcaatgattcagaagagcaccatgtgacagaaaagaaagaagaagaaccagtagctctgaacgcattcgaactgatttcgatgtcagcgggcctaaaccttggaaacttatttgactcagagcaggagttcaaaagagaaacaaggtttacatcaaaatgtccccccaaagaaattgtccgcaagatcgaggaagctgcaaaacctctaggatttgatgttcagaagaaaaattacaagttgaggctcgaaaaggtaaaggcagggaggaagggaaacctcaacgttgctactgagatactgcaagttgcgccctctctccacatggtagaagtccgaaaagcaaagggtgacactctggaatttcataagttctacaagaacctttccaagaccttgaaggacgtcgtctggaaatccgacgatcttcaaacgcaacatgcttcttga

SEQ ID NO: 436 - protein, 529 aa, Zea mays
MSSCLPAPRRHPALPRPSSRFPRSFSLSPPGYIDRICGLCAPRTRFVGSSIQLPPDVDQLPILKPQDRAWKLPDRTFHFPFRRGVRRRGMSTTKVKRRVGKYELGRTIGEGTFAKVRFARDTVTGEAVAIKILDKEKVLRHKMVEQIKREISTMKLIKHPNVVRIYEVMGSKTKIYIVLEFATGGELFDTIVNHGRMREDEARRYFQQLINAVDYCHSRGVYHRDLKPENLLLDSYGNLKVSDFGLSALSQQIKDDGLLHTTCGTPNYVAPEVLEDQGYDGAMADLWSCGVILFVLLAGYLPFEESNLMTLYKKISNAEFTFPPWTSFPAKRLLTRILDPNPMTRITIPEILEDEWFKKGYKRPEFDEQYDTTLDDVDAVFNDSEEHHVTEKKEEEPVALNAFELISMSAGLNLGNLFDSEQEFKRETRFTSKCPPKEIVRKIEEAAKPLGFDVQKKNYKLRLEKVKAGRKGNLNVATEILQVAPSLHMVEVRKAKGDTLEFHKFYKNLSKTLKDVVWKSDDLQTQHAS

SEQ ID NO: 437 - DNA, 888 bp, Zea mays
  CDS (1)..(888)
atgacgtcaccgaccaggcaagcactccgctccaccagagcctcctcgcctgtctgtccgacccacacacctaccggagcgcgcgtcccgaggtcggcggagcagggtcgggaggagggaatggcggtggtgggcgtcctcgcgctgcagggatcctacaacgagcacatggccgcgctgaggaggatcggagtgaagggggtggaggtgcgcaagccagagcagctcctcggcatcgactcgctcatcatccccggtggcgagagcaccaccatggccaagctcgccaactaccacaacctggtccctgcacttcgagagttcgtcggaggtggaaagcctgtctggggaacctgtgctgggctcatctttcttgcaaacaaagcagtagggcaaaaaacaggggggcaggaacttgttggaggattagattgtacagtccaccgaaacttttttgggagtcagcttcaaagctttgagacagagctttccgtgccaaagctttcggagaaggaaggagggaatgatacatgccgcggtgtatttatacgggcacctgctatattggaagtaggtccagatgttgaaatattggcggattgccctgttcctgttgacagacccagcattacaatatcatttggggagggtactgaggaagaagagtattcaaaagatcgggtaattgttgcagtgcggcaagggaacatcctcgcaactgctttccacccagaattgacatcagactccagatggcatcgtttcttcttggacatggataaagaatccccagcaaaggcgttttctgcgctctccctgtcgtcatcgtcaagagacactgaaggcctgccaaagaataagccgtttgatctgcccatttttgagtga

SEQ ID NO: 438 - protein, 295 aa, Zea mays
MTSPTRQALRSTRASSPVCPTHTPTGARVPRSAEQGREEGMAVVGVLALQGSYNEHMAALRRIGVKGVEVRKPEQLLGIDSLIIPGGESTTMAKLANYHNLVPALREFVGGGKPVWGTCAGLIFLANKAVGQKTGGQELVGGLDCTVHRNFFGSQLQSFETELSVPKLSEKEGGNDTCRGVFIRAPAILEVGPDVEILADCPVPVDRPSITISFGEGTEEEEYSKDRVIVAVRQGNILATAFHPELTSDSRWHRFFLDMDKESPAKAFSALSLSSSSRDTEGLPKNKPFDLPIFE

SEQ ID NO: 439 - DNA, 546 bp, Zea mays
  CDS (1)..(546): n means a or g or c or t/u
atggtaaccgcccttgagatcgttgaccacatcataaggaataggagtgactgtctcgagtgtagcaccctcaaccatgaagccaggtttgggtcccacgggctgcctcttggtgctgatcacctcaccgcgggccttggcatccgccttgagctggtcattcttggctttcctcaggcggaactcctctgtgcaacgggagggctgcacatgctccacgcggacatggatccgcttcctgatgatgcgaccgttaacctgcttgttgatctcgacgccgatggcgcgcttggtgacgttccagacgctcccggtgcggccgtggtagaacttgtgcggcatgcccttgtgcactgcgccgttaaccttgacgtcgacgtagtcgccgatcttgtaggtgcgcaggtacgtggtgagcgggatgtaccccttcttgcggaagggccgcgcgaacaggtcgcgggtccgcgaccgcagcccgtgnccccgccggcatcttcctgctccttcctccttactgcggctgggcggcgacggcggtnntga

SEQ ID NO: 440 - protein, 181 aa, Zea mays
  misc_feature (162)..(162): Xaa can be Thr or Pro or Ala or Ser
  misc_feature (181)..(181): Xaa can be any amino acid
MVTALEIVDHIIRNRSDCLECSTLNHEARFGSHGLPLGADHLTAGLGIRLELVILGFPQAELLCATGGLHMLHADMDPLPDDATVNLLVDLDADGALGDVPDAPGAAVVELVRHALVHCAVNLDVDVVADLVGAQVRGERDVPLLAEGPREQVAGPRPQPVXPPASSCSFLLTAAGRRRRX

SEQ ID NO: 441 - DNA, 690 bp, Zea mays
  CDS (1)..(690)
atgctcgtgcagcggcggcaggcggcagtgagagcgatgagcgcggcggcggcgagctcggtcaccaagttcatcaagtgcgtcacggtcggcgatggggccgtcgggaagacctgcatgctcatctgctacacctgcaacaagttccccacggattatatccccaccgtatttgacaacttcagcgccaatgtctccgtgggtgggagcatcgttaacttgggcctctgggacacggcaggccaggaggattacagcaggttgaggcctctcagctacaggggtgccgatgtgttcatcctctccttctccctggtcagcagggcgagctatgagaacgtcctcaagaagtggatgccagagcttcgccgattttcacctactgttcctgtagttcttgttggaaccaaactagatctccgtgaagacagatcttaccttgctgaccattctgctgcttccatcatctctactgaacagggagaagagctcaggaagcagataggcgctgtggcgtacatagaatgcagctcaaagacacagaggaacgtaaaggctgtgttcgacactgcaattaaagtagtgctgcaaccaccgaggagaagagaagttaccaggaagaaaatgaaggcaaggtcgaatcagtctctgagaagatacctctgtggaagcggatgtttcacatcgtga

SEQ ID NO: 442 - protein, 229 aa, Zea mays
MLVQRRQAAVRAMSAAAASSVTKFIKCVTVGDGAVGKTCMLICYTCNKFPTDYIPTVFDNFSANVSVGGSIVNLGLWDTAGQEDYSRLRPLSYRGADVFILSFSLVSRASYENVLKKWMPELRRFSPTVPVVLVGTKLDLREDRSYLADHSAASIISTEQGEELRKQIGAVAYIECSSKTQRNVKAVFDTAIKVVLQPPRRREVTRKKMKARSNQSLRRYLCGSGCFTS

SEQ ID NO: 443 - DNA, 798 bp, Zea mays
  CDS (1)..(798)
atgacgagcgtagaagataagcaaagcaaggcaaccgttgtcgttgtctctgttcctccgcttcctgctctcttggcttgctgcttgccctcggagcagtgccttccgccgccgccgccgccgcctgttgtgagaaggagaggccggggctgggaggagatgagcgtgaccaagttcatcaagtgcgtcacggtgggggacggcgcggtgggcaagacctgcatgctcatctgctacaccagcaacaagttccccacggattacatccccacggtgttcgacaacttcagcgccaacgtctccgtggacggcagcatcgtcaacctgggcctctgggacactgcaggacaagaggactacagcagattgcggccactgagctacaggggcgcggacgtgttcgtgctggccttctccttgatcagcagggcgagctatgagaacgtccttaagaagtgggtgccagagcttcgcagattcgcgcccgacgtcccggtcgttcttgtcgggaccaagttagatctccgtgaccacagggcctaccttgctgaccatcctggagcgtcgacgatcacgacggcacagggcgaagaactgaggaggcagatcggcgctgcggcttacatcgagtgcagttccaaaacgcagcagaatgtcaagtcggtcttcgacacagccatcaaagtggtccttcagcccccgcggaggagggaggcgacgcctgccaggaggaagaacaggcgtggctccgggtgctctatcatgaacctcatgtgtggcagcacgtgcgctgcttga

SEQ ID NO: 444 - protein, 265 aa, Zea mays
MTSVEDKQSKATVVVVSVPPLPALLACCLPSEQCLPPPPPPPVVRRRGRGWEEMSVTKFIKCVTVGDGAVGKTCMLICYTSNKFPTDYIPTVFDNFSANVSVDGSIVNLGLWDTAGQEDYSRLRPLSYRGADVFVLAFSLISRASYENVLKKWVPELRRFAPDVPVVLVGTKLDLRDHRAYLADHPGASTITTAQGEELRRQIGAAAYIECSSKTQQNVKSVFDTAIKVVLQPPRRREATPARRKNRRGSGCSIMNLMCGSTCAA

SEQ ID NO: 445 - DNA, 255 bp, Zea mays
  CDS (1)..(255)
atggctttccttgtcgctgtaccagggccacctgcacacctacaggttctgcgacaatgtctggaccttcattctaacagatgcaaccttcaagagcgaggagattcaagaaacactgggaagggtgaagatcgtggcctgcgattccaagttgctgcagcctcagcatccataaaacaagagtcgcctgctccatacatgttcactggcgccacccaaaccttcctagttcatgtgaatttttgctccctatga

SEQ ID NO: 446 - protein, 84 aa, Zea mays
MAFLVAVPGPPAHLQVLRQCLDLHSNRCNLQERGDSRNTGKGEDRGLRFQVAAASASIKQESPAPYMFTGATQTFLVHVNFCSL

SEQ ID NO: 447 - DNA, 804 bp, Zea mays
  CDS (1)..(804)
atgcacgagggttcactgagcacgttacgttgtaatggtgaaattagcagatttgcaagccctggcgtcgagttgatgaggtccatgttctctactgtagtgactgatccgatcaaagatattggaagaggtggtccaatggtggaatatgagaggagaatagcatcaggagagctagtagacggtgatagctttcaggttgatacaattcaacaattacaaaggctctatgaggagttgattgagaatgaagaagactgtcagctggatagatataaatcatctgagaaatcaggccggagtcgatggctatggtcccgcctcattactcagccttctacgtatgctcctattaagggcctttacctctatggtggtgttggtacagggaagacaatgcttatggacttgttctatgaacagctgccatttaattggagaaaaaaacgtattcactttcatgatttcatgctgaatgtacatagtcgtcttcagatgcacaaaggtgtttcagatccccttgatgttgtagcagctgagatttcagatgaggccatcatattatgtcttgatgagtttatggtaactgatgttgctgatgctatgattctgaaccgtctgttcagacaattgttcagcaaaggcgttattcttgtttcgacttctaaccgtgctccagataagctttatgaaggtggcttacaacgggaccttttcttgccatttattgacacccttgaagaaagatgcatcgtgcatgccattggatctgcggtggactatcgtcaactgggttctgcttga

SEQ ID NO: 448 - protein, 267 aa, Zea mays
MHEGSLSTLRCNGEISRFASPGVELMRSMFSTVVTDPIKDIGRGGPMVEYERRIASGELVDGDSFQVDTIQQLQRLYEELIENEEDCQLDRYKSSEKSGRSRWLWSRLITQPSTYAPIKGLYLYGGVGTGKTMLMDLFYEQLPFNWRKKRIHFHDFMLNVHSRLQMHKGVSDPLDVVAAEISDEAIILCLDEFMVTDVADAMILNRLFRQLFSKGVILVSTSNRAPDKLYEGGLQRDLFLPFIDTLEERCIVHAIGSAVDYRQLGSA

SEQ ID NO: 449 - DNA, 417 bp, Zea mays
  CDS (1)..(417)
atggggctcgggttgatccatcggatccgaaggggcatggctctggtcagattggcgtttcccgtgttcttcttcctcgcagcggcggagttcgcggcggggacgcggtcgccgtcggctttcgtacaaaacgccatctactccaaccgcatcaccatcttctccaagacttactgcccctactccatgcgtgctaagcacatatttcgagaccttaaggaagatccatatgttgttgaactagatacccgagtggatgggcgtgacattcaaagtgttctcctggacctagttgggcgtcgtactgtgccacaggtgtttgtcaatggacagcatattggtggctcagacgatacagtaaatgcgctttcaaatggacagctccagaaacttctcgggaagagtcagtcacaatga

SEQ ID NO: 450 - protein, 138 aa, Zea mays
MGLGLIHRIRRGMALVRLAFPVFFFLAAAEFAAGTRSPSAFVQNAIYSNRITIFSKTYCPYSMRAKHIFRDLKEDPYVVELDTRVDGRDIQSVLLDLVGRRTVPQVFVNGQHIGGSDDTVNALSNGQLQKLLGKSQSQ

SEQ ID NO: 451 - DNA, 1233 bp, Zea mays
  CDS (1)..(1233)
atgcggcgctcgcgcggctttctttcccaactccgacgaaggctagctacaccaccttgtgcgggctcgtctccatcgcccgccacccgctccgtcgtcgtcgtccccgccgcgccgatcccgaatcgaatggggagcctggcgtccgagaggaaggtggtcgggtgggccgccagggacgccaccggacacctctccccctactcctacaccctcaggaacacaggccctgaagatgtggtggtgaaggtgctctactgcgggatctgccacacggacatccaccaggccaagaaccacctcggggcttcaaagtatcctatggtccctgggcacgaggtggtcggcgaggtggtggaggtcgggcccgaagtggccaagtacggcgtcggcgacgtggtaggcgtcggggtgatcgttgggtgctgccgcgagtgcagcccctgcaaggccaacgttgagcagtactgcaacaagaagatctggtcatacaacgacgtctacactgatggacggcccacgcagggtggattcgcctccaccatggtcgtcgaccagaagtttgtggtgaagatcccggcgggtctggctccggagcaagcggcgccgctgctgtgcgctggcgtgacggtgtacagcccgctgaagcactttgggctgacgaacccgggcctccgtggcggcatcctgggcctcggcggcgtgggccacatgggcgtgaaggtagccaaggccatgggccaccacgtgacggtgatcagctcgtcgtccaagaagcgcgcggaggcaatggaccacctcggcgcggacgcgtacctagtgagctcggacgccgcggccatggcggcggccgccgactcgctggactacatcatcgacacggtgcccgtgcaccacccgctggagccgtacctggcgctgctgaagctggacggcaagctcgtgctgctgggcgtcatcggcgagcccctgagcttcgtgtcgcccatggtgatgctggggcggaaggccatcacggggagcttcatcggcagcatcgacgagaccgctgaggtgcttcagttctgcgtcgacaaggggctcacctcccagatcgaggtggtcaagatggggtacgtgaacgaggcgctggagcggctggagcgcaacgacgtccgctaccgcttcgtcgtcgacgtcgccggtagcaacgtcgaggcggaggcggcggcggcggatgcggccagcaactga

SEQ ID NO: 452 - protein, 410 aa, Zea mays
MRRSRGFLSQLRRRLATPPCAGSSPSPATRSVVVVPAAPIPNRMGSLASERKVVGWAARDATGHLSPYSYTLRNTGPEDVVVKVLYCGICHTDIHQAKNHLGASKYPMVPGHEVVGEVVEVGPEVAKYGVGDVVGVGVIVGCCRECSPCKANVEQYCNKKIWSYNDVYTDGRPTQGGFASTMVVDQKFVVKIPAGLAPEQAAPLLCAGVTVYSPLKHFGLTNPGLRGGILGLGGVGHMGVKVAKAMGHHVTVISSSSKKRAEAMDHLGADAYLVSSDAAAMAAAADSLDYIIDTVPVHHPLEPYLALLKLDGKLVLLGVIGEPLSFVSPMVMLGRKAITGSFIGSIDETAEVLQFCVDKGLTSQIEVVKMGYVNEALERLERNDVRYRFVVDVAGSNVEAEAAAADAASN

SEQ ID NO: 453 - DNA, 957 bp, Zea mays
  CDS (1)..(957): n means a or g or c or t/u
atggatcatcacgatccaggtggggcaatgtggaaaccagatcgggatggagttctggaagcagctctgtctcgagcacggtatcggcaaggacggcctgctcgaggacttcgccactcagggggcgacaggaaggacgtcttcttttaccaggctgatgatcagcacttcatacccaggtctctgcttattgacctggagccgagagtgatcaatggaatccagaacagtgagtacaggaacctgtacaaccacgagaacatatttgtcgctgagcatggtggtggtgccgggaacaactgggccagtgggtatcatcagggtgaacaagttgttgatgatatcatggacatggttgacagagaagcagatggaagtgatagccttgagggttttgtcctttgtcattctattgctggtggaactggttcaggtatgggttcttatctgttggagacactgaatgatcgatacagtaaaaagcttgtgcagacatatagtgttttcccaaatcaggtggaaacaagtgatgttgtcgtccaaccttacaactcacttttgactctgaagcggctgacactgaatgctgactgtgtggttgttcttgacaatacggctcttaataggattgccgttgagcgccttcatctatcaaatcctacgtttgcacaaacaaactctttggtctccacggttatgtctgcaagcacaactactttaaggtatcctggatatatgaacaatgatctggttggccttcttgcctccttgattcccactccaaggtgtcattttttgatgacaggttatactccgttgactgtggagcgccaggttaacatgatacgcaaaacgacggtattggatgttannnnnnnnnnnnnnnnnnnnnnnnnnnnnnnnnnnnnnnnnnnnnnnnnntttttttttttttttcatcgcacagtgctcaaatga

SEQ ID NO: 454 - protein, 318 aa, Zea mays
  misc_feature (291)..(291): Xaa can be any amino acid
  misc_feature (292)..(307): Xaa can be any amino acid
MDHHDPGGAMWKPDRDGVLEAALSRARYRQGRPARGLRHSGGDRKDVFFYQADDQHFIPRSLLIDLEPRVINGIQNSEYRNLYNHENIFVAEHGGGAGNNWASGYHQGEQVVDDIMDMVDREADGSDSLEGFVLCHSIAGGTGSGMGSYLLETLNDRYSKKLVQTYSVFPNQVETSDVVVQPYNSLLTLKRLTLNADCVVVLDNTALNRIAVERLHLSNPTFAQTNSLVSTVMSASTTTLRYPGYMNNDLVGLLASLIPTPRCHFLMTGYTPLTVERQVNMIRKTTVLDVXXXXXXXXXXXXXXXXXFFFFFHRTVLK

SEQ ID NO: 455 - DNA, 594 bp, Zea mays
  CDS (1)..(594): n means a or g or c or t/u
atgggctctantgnaagcgcgtgtaaagtgggggaaggaaaattccagcggggcgagcgctcgaagcgcggtttcctcgtgctcgatccatcccctgccgcttccaggtccgagcgagctgatccctccccaccaccggtcccatgggcggaccaactcaccgacgaccagatcggcgaggtcaaggaggccttcagcctcttcgacaaggacggggatggttgcatcacgaccaaggagctgggaactgtcatgcgttcactggggcaaaaccctacagaggctgagctccaggacatgatcaatgaggtcgatgccgatggcaacggcaccatcgattttccagagtttctgaaccttatggctcgcaagatgaaggacaccgactctgaggaagagctcaaggaggcctttcgtgtgtttgacaaggaccagaacggcttcatctccgccgccgagctccgccatgtcatgacaaatcttggggagaagctaactgatgaggaggtagacgagatgatccgtgaggctgatgtcgatggtgatggccagattaactacgaggagtttgttaaggtcatgatggccaagtga

SEQ ID NO: 456 - protein, 197 aa, Zea mays
  misc_feature (4)..(4): Xaa can be Asn or Thr or Ser or Ile
  misc_feature (5)..(5): Xaa can be Ala or Glu or Gly or Val
MGSXXSACKVGEGKFQRGERSKRGFLVLDPSPAASRSERADPSPPPVPWADQLTDDQIGEVKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 457 - DNA, 492 bp, Zea mays
  CDS (1)..(492)
atggtgatggtgatcagcacccaggccaagccccgccttcagaagttctacagtttccagccacccgagaagcatcaggacctcgtccgctgtgtcttccaattactctctgcaaggcccgagagcgcgagcaattttgtcaaggtggactccatctttggcccgggaacaaaaatggtctacaagcatttggccacactatactttgtttttgtctttgatagctctgagaacgagcttgccatgctcgacctcgtacaagtgtttgttgaaacattggacagatgcttcaagaatgtatgcgagcttgacatcgtatttaacttcaacaagctgcacaccattttggatgagatgatatcggggggacaggtgatcgaaacaagttcagaacagataatgaaatctgtggaagagattgaaaggctggagaaacaatcgagcacaaccagcttcatacccaagtcgattacagagcgttttacccgttga

SEQ ID NO: 458 - protein, 163 aa, Zea mays
MVMVISTQAKPRLQKFYSFQPPEKHQDLVRCVFQLLSARPESASNFVKVDSIFGPGTKMVYKHLATLYFVFVFDSSENELAMLDLVQVFVETLDRCFKNVCELDIVFNFNKLHTILDEMISGGQVIETSSEQIMKSVEEIERLEKQSSTTSFIPKSITERFTR

SEQ ID NO: 459 - DNA, 738 bp, Zea mays
  CDS (1)..(738)
atggacgcgtcgcacacgggctcctccgcagcctccggcgacgccccgaccaccggggagcaccggatggggaccaccattgtcggggtctgctacgagggtggcgtcgtcctcggcgctgattccaggaccagcactggaatgtatgtagccaaccgtgcttcagacaagattacccaattgacagacaatgtgtacgtttgtcgctctggatctgctgctgatacacaagtcatttcggactatgtacgttatttcctccaccaacacacaatccagcttggacaaccagctactgttaaagttgcagctaacttgattaggttgctagcttatcagaataagaacatgttgcaagctggcatgattgttggaggatgggataagtacgagggaggccaaattttctcagtccctcttggtggaacgatcttgaaacaaccatttgcaattggaggctcaggttccagttatctttatgcacttcttgatcatgaatggaaagagggaatgagccaggaagaggcagagaaatttgtggtgaaggtagtttcccttgctatggcccgtgatggtgctagcggaggggttgtccgtacagttacaataaatgcggatggcgtgaagaggaacttctaccctggcgacaagctacccctgtggcacgacgagctggagccccagaactcgttgctcgatattcttgctgccgggaaccctgatcccatggtgcagtga

SEQ ID NO: 460 - protein, 245 aa, Zea mays
MDASHTGSSAASGDAPTTGEHRMGTTIVGVCYEGGVVLGADSRTSTGMYVANRASDKITQLTDNVYVCRSGSAADTQVISDYVRYFLHQHTIQLGQPATVKVAANLIRLLAYQNKNMLQAGMIVGGWDKYEGGQIFSVPLGGTILKQPFAIGGSGSSYLYALLDHEWKEGMSQEEAEKFVVKVVSLAMARDGASGGVVRTVTINADGVKRNFYPGDKLPLWHDELEPQNSLLDILAAGNPDPMVQ

SEQ ID NO: 461 - DNA, 348 bp, Zea mays
  CDS (1)..(348): n means a or g or c or t/u
atgtctgatctcgacgtccagcttccatctgcctttgatccgtttgctgaggcaaatgctgaggactctggtgctggtcctggaacgaaggattatgtgcatgtgcgcatccagcagcgcaacggcagaaagagtctgactacagtccagggtctgaagaaagagttcagctataacaagatcctcaaggatctgaagaaggaattctgctgcaatggtactgtagttcaggacccagagctaggccaggtcattcagctccaaggtgatcagcgcaagaatgttgctactttcctagttcaggctgngattgcgaagaaagagaacatcaagattcacgggttctga

SEQ ID NO: 462 - protein, 115 aa, Zea mays
  misc_feature (103)..(103): Xaa can be Ala or Glu or Gly or Val
MSDLDVQLPSAFDPFAEANAEDSGAGPGTKDYVHVRIQQRNGRKSLTTVQGLKKEFSYNKILKDLKKEFCCNGTVVQDPELGQVIQLQGDQRKNVATFLVQAXIAKKENIKIHGF

SEQ ID NO: 463 - DNA, 834 bp, Zea mays
  CDS (1)..(834)
atgctcccctgcccctcgcagcggctactctacaggtctagcgactctttcgccatccatagagggaggaggcgcggcggagatggtgggcggtggcggcggcgggccgtgcggcgggtgggcaagtacgaggtgggacgcaccatcgaggaaggcaccttcgccaaggtcaagttcgcgcagaacaccgagaccggggaaagcgtcgccatgaaggtgctcgaccgctcctccatcctcaagaacaagatggccgaacagattaagagagaaatatccataatgaagcttgtcaggcatcccaatgtcgttaggctacacgaggttttggcaagccggaagaagatatttataattctggagttcatcactggcggcgagctattcgataaaattattcgtcatgggagactcagtgaagcagatgcacgcagatactttcagcagcttattgatggtgttgatttttgtcacaagaaaggagtctaccatcgagacttaaagcctgaaaatctcctccttgattcccaaggcaatcttaaaatttcagactttggactgagtgcatggcctgctcagggatctttccttctacgtacaacctgtgggactccgaactatgttgccccagaggttctcagtcataagggatataatggcgcacttgctgatacatggtcatgtggagtaattttatatgtattgttagcaggttatcttccatttgatgaagtggacctgactaccctttatggaaagattgagagtgcagaatattcattcccagcctggttttcaggtggtgcgaaatcactgattcgtagaattctttga

SEQ ID NO: 464 - protein, 277 aa, Zea mays
MLPCPSQRLLYRSSDSFAIHRGRRRGGDGGRWRRRAVRRVGKYEVGRTIEEGTFAKVKFAQNTETGESVAMKVLDRSSILKNKMAEQIKREISIMKLVRHPNVVRLHEVLASRKKIFIILEFITGGELFDKIIRHGRLSEADARRYFQQLIDGVDFCHKKGVYHRDLKPENLLLDSQGNLKISDFGLSAWPAQGSFLLRTTCGTPNYVAPEVLSHKGYNGALADTWSCGVILYVLLAGYLPFDEVDLTTLYGKIESAEYSFPAWFSGGAKSLIRRIL

SEQ ID NO: 465 - DNA, 783 bp, Zea mays
  CDS (1)..(783)
atgagcctcgtcgcgggagatgagctcgttggagaaggtgaggcccggcatgagcccgcgcttcttgagccagaagatggcgcagaaggaccccgagaagaatatgccctcgacgcaggcgaaggcaacgatgcgctcagcgaagcgctccccgccgtcgatccagcgcatggcccagtcagccttgcgccggaccgcgggcacggtgtcgatggcgcggaacaggcggtccttctcgacgtggtcgcggatgtaggtctcgagcagcagcgaatacatctccgagtggatgttctcgatggcgatctggaagccgtagaaggcccgcgcctcggcgacctgcacgtcggtcatgaagcgggaagcgaggttctcgagcacgatgccgtcggaggcagcgaagaaggcgagcacgtgggagatgaagtgccgctcgtcgggggacagcgcctcgtcccagtgccgggcgtcggcagagaggtcaacctcctccgccgtccagaaggaggccaccgccttcttgtagaactcccagatctgcgggaaacggatcgggaacatggagaagcggtcggaggactccgccagcagcggctcctccgcgtcgcacgggggcaacagcgtcggcgcggcaggcatcgtcggaggattgtggggacggttgctagtggggaattgggcgaaagttttgtgatttacggaggagagcagggaggcgggggatttataggaatggtgggaattagagtacagattttgcggacgcgtgggcggacgcgttga

SEQ ID NO: 466 - protein, 260 aa, Zea mays
MSLVAGDELVGEGEARHEPALLEPEDGAEGPREEYALDAGEGNDALSEALPAVDPAHGPVSLAPDRGHGVDGAEQAVLLDVVADVGLEQQRIHLRVDVLDGDLEAVEGPRLGDLHVGHEAGSEVLEHDAVGGSEEGEHVGDEVPLVGGQRLVPVPGVGREVNLLRRPEGGHRLLVELPDLRETDREHGEAVGGLRQQRLLRVARGQQRRRGRHRRRIVGTVASGELGESFVIYGGEQGGGGFIGMVGIRVQILRTRGRTR

SEQ ID NO: 467 - DNA, 402 bp, Zea mays
  CDS (1)..(402)
atgtccaactcagggatttctttggggaccaatcaaactcaagaactaagtttcatgtctgatctcgacgtccagcttccatctgcttttgatccgtttgcagaggcaaatgctgaggactccagtgctggtgctggatcaaaggactatgtgcacgtgcgtattcagcagcgcaacggaaggaagagtctgacaactgttcagggcttgaagaaagagtacagctacaacaagatcctcaaggatctcaaaaaagagttctgctgcaatggtactgtagtccaggatccagagctaggccaggtcattcaactgcaaggtgatcagcgtaaaaatgtcgctacttttctagtccaggccggaatcgtgaaaaaagatagcatcaagattcacggattttga

SEQ ID NO: 468 - protein, 133 aa, Zea mays
MSNSGISLGTNQTQELSFMSDLDVQLPSAFDPFAEANAEDSSAGAGSKDYVHVRIQQRNGRKSLTTVQGLKKEYSYNKILKDLKKEFCCNGTVVQDPELGQVIQLQGDQRKNVATFLVQAGIVKKDSIKIHGF

SEQ ID NO: 469 - DNA, 1443 bp, Zea mays
  CDS (1)..(1443)
atgagagattggagggaggcccctgcccaaggcaagagaaaccgcggcgcgcggagagggaggaagggcagacgcagacgggcgaacaagatgagggagatcatcagcatccacatcggccaggccgggatccaggtcggcaacgcctgctgggagctctactgcctcgagcacggcatcgagcacgatggcaccatgcccagtgattcctcggttggcgtcgcacatgatgccttcaacacgttcttcagcgagactggttccggcaagcatgtgcccagggccatcttcgtcgaccttgagcccactgtcatcgacgaggttcgcactggctcgtaccgccagctcttccacccagagcagctcatctcggggaaggaggacgcagctaacaactttgcccgtggccactacacggttgggaaggagattgtcgatctatgcctggaccgtgtgcgcaagcttgcagacaactgcactgggctgcagggattcttggtgttcaatgctgttggtggtggtactggctctggacttggttcactgctgttggagcgcctttcagttgattatggcaagaagtctaagcttggtttcaccatttatccttccccacaggtgtcaacagctgttgtagagccatacaacagtgtcctctcgacccactccttgcttgagcacactgatgttgcagtcctcctggacaacgaggctatctatgacatatgcaggaggtcccttgacatcgaaaggccaacctacaccaacttgaacaggctgatctcacagatcatatcatctctaaccacctccctgaggtttgatggtgctatcaatgtggatgtcaccgagttccagaccaaccttgttccatacccacgtattcatttcatgctttcctcatatgcccctgtaatatctgctgagaaggcctaccatgagcagctctctgtgcctgaaatcaccaatgctgtatttgagccctcaagcatgatggccaagtgtgacccaaggcatgggaagtacatggcttgctgcttgatgtaccgtggtgatgttgttcccaaggatgtcaatgctgcagtcgcaaccatcaagaccaagagaactgtccagtttgtggactggtgccccaccggattcaagtgtggcatcaactaccagccaccgtctgttgtccctggaggcgacctggcaaaggtccagcgtgccgtgtgtatgatcagcaacaacactgccgttgctgaggtgttctcgcgcatcgatcacaagttcgaccttatgtacgccaagcgggcgttcgttcactggtacgtcggtgagggtatggaagagggtgagttctcagaggcccgtgaggacttggctgctcttgagaaggactatgaggaagtcggcgcagagggtgcagatgacgagggtgacgagggcgatgactattga

SEQ ID NO: 470 - protein, 480 aa, Zea mays
MRDWREAPAQGKRNRGARRGRKGRRRRANKMREIISIHIGQAGIQVGNACWELYCLEHGIEHDGTMPSDSSVGVAHDAFNTFFSETGSGKHVPRAIFVDLEPTVIDEVRTGSYRQLFHPEQLISGKEDAANNFARGHYTVGKEIVDLCLDRVRKLADNCTGLQGFLVFNAVGGGTGSGLGSLLLERLSVDYGKKSKLGFTIYPSPQVSTAVVEPYNSVLSTHSLLEHTDVAVLLDNEAIYDICRRSLDIERPTYTNLNRLISQIISSLTTSLRFDGAINVDVTEFQTNLVPYPRIHFMLSSYAPVISAEKAYHEQLSVPEITNAVFEPSSMMAKCDPRHGKYMACCLMYRGDVVPKDVNAAVATIKTKRTVQFVDWCPTGFKCGINYQPPSVVPGGDLAKVQRAVCMISNNTAVAEVFSRIDHKFDLMYAKRAFVHWYVGEGMEEGEFSEAREDLAALEKDYEEVGAEGADDEGDEGDDY

SEQ ID NO: 471 - DNA, 786 bp, Zea mays
  CDS (1)..(786)
atgcacgaggcaaacaccaccaccaaagaaggcgagaacgctccccttcccctccagtctccaggaccgtctcctcgcctgctcatctgccgctgctccccttctctgggctcggagaatcggagagaagcgcgcgcggccatggcgtccagcgcctctcggttcatcaagtgcgtcacggtcggcgacggtgccgtgggcaagacatgtatgctcatctgctacaccagcaacaagttccccactgactacatacctacggtgttcgacaatttcagtgcaaatgtagttgtggatggcaccactgtgaatttgggcctttgggataccgctgggcaggaagattacaaccgcctgaggcctctaagctaccgaggtgcagatgttttcgtgcttgcattctcacttgtgagccgagctagctatgagaatatcatgaagaagtggataccagagcttcaacattatgcacctggggtgcccgttgttttggcaggcacaaaattggatcttcgtgaagacaagcactacttgatggaccatcctggattggtgcctgttaccactgcacagggggaggaacttcgtagacaaattggtgctatgtattacattgaatgcagctcaaagacacagcagaatgtcaaagctgtgttcgatgctgccatcaaggtagtaatccagcctccaactaaaataagagaaaagaagaagaaaaaatcacgcaaaggatgttctatgatgaacatcttcggtggaagaaaaatgatatgcttcaagtcctga

SEQ ID NO: 472 - protein, 261 aa, Zea mays
MHEANTTTKEGENAPLPLQSPGPSPRLLICRCSPSLGSENRREARAAMASSASRFIKCVTVGDGAVGKTCMLICYTSNKFPTDYIPTVFDNFSANVVVDGTTVNLGLWDTAGQEDYNRLRPLSYRGADVFVLAFSLVSRASYENIMKKWIPELQHYAPGVPVVLAGTKLDLREDKHYLMDHPGLVPVTTAQGEELRRQIGAMYYIECSSKTQQNVKAVFDAAIKVVIQPPTKIREKKKKKSRKGCSMMNIFGGRKMICFKS

SEQ ID NO: 473 - DNA, 477 bp, Zea mays
  CDS (1)..(477)
atggttttcgccacaccgctttcgtcctccgcgaagatgccgaagaacaagggtaagggaggcaagaaccggaagcgtggaaagaacgaggctgacgacgacaagcgcgagctcgtcttcaaggaagacgggcaggagtatgcgcaggtgacccggatgctcggcaacgggcggtgcgaggccacctgcgtggacggcacgcgccgcctctgccatatccggggcaagatgcacaagaaggtgtggatcgcggccggggacatcgtcctcgtcggcctccgcgactaccaggacgacaaggccgacgtcatcctcaagtacatgaacgacgaggcgcgcctgctcaaggcctacggggagcttcccgagacgctcaggctcaacgagggcgtcgacgtcgatgggcccgaggagggcgaggagaacggcgactacaactacatccagttcgaggacgaggacatcgacaagatctga

SEQ ID NO: 474 - protein, 158 aa, Zea mays
MVFATPLSSSAKMPKNKGKGGKNRKRGKNEADDDKRELVFKEDGQEYAQVTRMLGNGRCEATCVDGTRRLCHIRGKMHKKVWIAAGDIVLVGLRDYQDDKADVILKYMNDEARLLKAYGELPETLRLNEGVDVDGPEEGEENGDYNYIQFEDEDIDKI

SEQ ID NO: 475 - DNA, 495 bp, Zea mays
  CDS (1)..(495)
atgattcggcacgaccggcgacgccactactcctgcctcacgccgccgctcaaaccgcagaagggagaagagaagcacgcccaaaaattccgaggttttcacctcttggagcgcaccaacaccacccggagaccggagcgactcgccaccggcgcggaaaaggagggcggaggctcgatggcggatgagaatcaggctggaaagaaagaggaggaggaatttagcacaggccctctgtcagtcctaatgatgagtgttaagaacaacacccaggtcctcatcaattgccgcaacaacaagaagctgcttggccgtgttcgtgcttttgatcgccactgtaacatggtgctcgagaacgtgcgtgagatgtggacagagatccccaagactggcaagggcaaaaagaaggctctgcctgtgaacaaggatagattcatcagtaagatgttcctcaggggcgactcggtcatcatagtgctgaggaacccgaagtga

SEQ ID NO: 476 - protein, 164 aa, Zea mays
MIRHDRRRHYSCLTPPLKPQKGEEKHAQKFRGFHLLERTNTTRRPERLATGAEKEGGGSMADENQAGKKEEEEFSTGPLSVLMMSVKNNTQVLINCRNNKKLLGRVRAFDRHCNMVLENVREMWTEIPKTGKGKKKALPVNKDRFISKMFLRGDSVIIVLRNPK

SEQ ID NO: 477 - DNA, 873 bp, Zea mays
  CDS (1)..(873)
atggaatccgcacacccatcatccatggccgcgcgccctgctccgccgctcgccggcggcgcgcgcgctcctctcgccggcactctcgtcccgcctcgtcgcgtccaagccccactcctcgtcccccgcgccgccgccacctgcgaaggccgactccagcacgaagaccttctcgatctaccggtgggacccggactcgccgtcgacgaagccgcacctcaaggactaccaggtggacctgtccgactgcgggccgatggtgctggacgcgctgctcaagatcaagaacgagcaggacccgtcgctcaccttccgccgcagctgccgcgagggcatctgcgggactgcgccatgaacatcgacggcgacaacggcctcgcctgcctcaccaagatctccggcgcctcctccgcgtccacggtctcgccgctgccccacatgttcgtcgtcaaggacctggtggtggacatgaccaacttctacaaccagtacaagagcgtcgagccgtggctcaagcgcaaggacccgccgccgcagctaggcaaggaggtcccgcagaccaaggccgaccgcgccaagctcgacggcatgtacgagtgcatcctctgcgcctgctgctccacctcctgcccatcctactggtggaaccccgaggagtacctcggcccagccgcgctgctccacgccaataggtggatacaggacagccgtgaccagttcaccaaggagcgcctggacgccatcaacgacgagttcaagctgtaccgctgccacaccatcaagaactgcacgcatgcctgccccaagggcctgaacccggcaaagcagatcgacacgatcaagaagctccagttgggtgccccaagtgcctga

SEQ ID NO: 478 - protein, 290 aa, Zea mays
MESAHPSSMAARPAPPLAGGARAPLAGTLVPPRRVQAPLLVPRAAATCEGRLQHEDLLDLPVGPGLAVDEAAPQGLPGGPVRLRADGAGRAAQDQERAGPVAHLPPQLPRGHLRDCAMNIDGDNGLACLTKISGASSASTVSPLPHMFVVKDLVVDMTNFYNQYKSVEPWLKRKDPPPQLGKEVPQTKADRAKLDGMYECILCACCSTSCPSYWWNPEEYLGPAALLHANRWIQDSRDQFTKERLDAINDEFKLYRCHTIKNCTHACPKGLNPAKQIDTIKKLQLGAPSA

SEQ ID NO: 479 - DNA, 1536 bp, Zea mays
  CDS (1)..(1536)
atggaggagagctcggagcgggagggtacgggccgtcggatgctcgcagctgccaccgccgcctacggctattttaaccccgcgctcctgccgacgccgcactcgcccccggcctcctcccgcctcccagatctcgctcgctcggcgccagttgcctcgcagtttggatcatctcatacctcggcgaagatgagggagatcctgcacatccagggagggcaatgtggcaaccagattggcgccaagttctgggaggtggtgtgcgatgaacatggcattgaccctaccgggcggtacactggcaattccgaccttcagttggagcgtgttaatgtctactacaatgaagcctcctgcggacgctttgttccccgcgctgttctcatggatcttgagcctgggacaatggacagtgtccggaccggaccctatgggcagatcttccgccctgacaactttgtgtttgggcaatctggtgctggtaacaattgggctaagggccactacaccgagggtgctgagctcattgactctgttctggatgttgtgaggaaggaagctgagaactgtgactgcttgcaaggattccaagtatgccactcccttggtggcggtactggatctggtatgggtacgctgttgatctcaaagatcagggaggagtaccctgaccgcatgatgctgacattctcagttttcccctcaccgaaagtatctgataccgtggttgagccatacaatgccactctttctgtccaccagttggttgagaatgctgatgagtgcatggttctcgataacgaagccctctatgacatctgcttcaggactcttaagctgaccacccctagctttggtgatctgaaccatttcatctctgcaaccatgagtggagtcacctgctgcctaaggttccctggtcagctcaactccgacctccggaagctggccgtgaacctgatcccgttccctcgcctccacttcttcatggtcgggttcgccccgctgacgtcccgcgggtcccagcagtaccgcgccctcacggtccccgagctgacccagcagatgtgggacgccaagaacatgatgtgcgccgctgacccccgccacgggcggtacctgacggcctcggccatgttccgcgggaagatgagcaccaaggaggtggacgagcagatgatcaacgtgcagaacaagaactcgtcctacttcgtggagtggatccccaacaacgtgaagtccagcgtgtgcgacatcccgccgaggggcctgtccatggcgtccaccttcgtcggcaactcaacttccatccaggagatgttccggagggtgagcgagcagttcactgccatgttcaggaggaaggctttcttgcactggtacacgggcgagggcatggacgagatggagttcaccgaggccgagagcaatatgaatgacctcgtatcggagtaccagcagtaccaggatgcgactgctgatgacgatgaggaggccgagtatgaggacgaggaggagccagctgatggcatgtga

SEQ ID NO: 480 - protein, 511 aa, Zea mays
MEESSEREGTGRRMLAAATAAYGYFNPALLPTPHSPPASSRLPDLARSAPVASQFGSSHTSAKMREILHIQGGQCGNQIGAKFWEVVCDEHGIDPTGRYTGNSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHFISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPRGLSMASTFVGNSTSIQEMFRRVSEQFTAMFRRKAFLHWYTGEGMDEMEFTEAESNMNDLVSEYQQYQDATADDDEEAEYEDEEEPADGM

SEQ ID NO: 481 - DNA, 495 bp, Zea mays
  CDS (1)..(495)
atgccggctggccacgggctgcgctcgcggacgcgcgacctgttcgcgcgccccttccgcaagaagggctacatcccgctcaccacctacctccgcacctacaagatcggcgactacgtcgacgtcaaggtgaacggcgccgtccacaaggggatgccgcacaagttctaccacggccgcaccggtcgcgtctggaacgtcaccaagcgcgccatcggcgtcgagataaacaagcaggtgaatggtcgcatcatcaggaagcgtatccatgtccgcgtggagcatgtgcagccgtcccgctgcacagaagagttccgcctgaggaaggtgaagaatgatcagctgaaggcggatgcaaaggagcgcggcgaggtcatcagcaccaagaggcagccgttgggccccaagcctggcttcatggttgaggggactaccatcgagaccgtcactcccatcccgtacgatgtggtcaatgatcttaagggcggatactga

SEQ ID NO: 482 - protein, 164 aa, Zea mays
MPAGHGLRSRTRDLFARPFRKKGYIPLTTYLRTYKIGDYVDVKVNGAVHKGMPHKFYHGRTGRVWNVTKRAIGVEINKQVNGRIIRKRIHVRVEHVQPSRCTEEFRLRKVKNDQLKADAKERGEVISTKRQPLGPKPGFMVEGTTIETVTPIPYDVVNDLKGGY

SEQ ID NO: 483 - DNA, 897 bp, Zea mays
  CDS (1)..(897): n means a or g or c or t/u
atgggtcgacttcgctgtcgacgatttcgtagaaaaggggcaggaagaaatcgagcctcactcganccatcgcctcgccgcagcacanacgaggccggcggcgccatggccatgaagctggacatgtccgcgctcgagaccaacttcgccaacctgaccgcctccgccggcgacgacacgtacttctccgccgaggcccccgacgtgccgtccatggtgctccccatctgcgacgacttcgacggcttccaggcggccaccaaggatatggtgaagaataagaaggggacgaccacgcttgccttcatcttcgacaagggcgtcatcgtcgccgctgattccagggccagcatgggcggttatatatcctcacaaaccgtgaggaaaattattgaaataaatccttacatgctggggacaatggctggaggtgctgctgattgccaattttggcataggaacctaggaaccaagtgtcgtctccatgagccttcaaacaagcgaaggatctctattgctggtgcttccaaactgttggctaacatcctttattcatatcgtgggatgggactgtcgattggtacaatgatcgctggatgggatgagaagggtcctggcttgtactatgttgacagtgagggtgcgcggctcgtggggaacaggttctctgttggctctggttcactgtatgcttatggtatcttggatgatggttaccgcttcagcatgtcagttgaggaagccgccgaattagcgcgacgggctatttatggggcaacattccgtgatgcagcaagtggcggttgtgttagtgtttaccacgttggccctgatggttggacgaagctttctggggatgatgtcggggagctgcactaccactactacccggtttga

SEQ ID NO: 484 - protein, 298 aa, Zea mays
  misc_feature (22)..(22): Xaa can be Asp or Glu
  misc_feature (30)..(30): Xaa can be Asn or His or Asp or Tyr
MGRLRCRRFRRKGAGRNRASLXPSPRRSTXEAGGAMAMKLDMSALETNFANLTASAGDDTYFSAEAPDVPSMVLPICDDFDGFQAATKDMVKNKKGTTTLAFIFDKGVIVAADSRASMGGYISSQTVRKIIEINPYMLGTMAGGAADCQFWHRNLGTKCRLHEPSNKRRISIAGASKLLANILYSYRGMGLSIGTMIAGWDEKGPGLYYVDSEGARLVGNRFSVGSGSLYAYGILDDGYRFSMSVEEAAELARRAIYGATFRDAASGGCVSVYHVGPDGWTKLSGDDVGELHYHYYPV

SEQ ID NO: 485 - DNA, 882 bp, Zea mays
  CDS (1)..(882)
atgtacgcgggggagcaaacaaaacgatatgccgctgccctgaaccgagaccaccaccgctctgcctcgcctcgcctcgcctcgcgtcgtctcacctcacctcgccgactagggttttgtaccgccgtggatctcgccgtccccgccatggacgtctcgcacgcgggatcctccgtcgccggcgaggctccgacgaccggggagcaccggatggggactaccatcgtcggggtctgctacgagggcggcgtcgtcctgggcgccgattccaggaccagcactggaatgtatgtagccaaccgtgcttcagacaagattactcaactgacagacaatgtgtatgtctgtcgctctggatctgctgctgatacacaagtcatttcggattatgtacgctatttcctccaccaacacacaatccagcttggacaaccagctaccgttaaagttgcagccaacttgattaggttgctagcttatcagaacaagaacatgttgcaagctggcatgattgttggaggatgggacaagtacgagggaggccaaattttctcagtccctctcggtggaacgatcttgaagcaaccatttgcaattggaggttcaggttccagttacctatatgctcttcttgatcatgaatggaaagagggaatgagtcaggaagaggcagagaaatttgtggtgaaggtagtttcccttgctatggcccgtgatggtgctagtggaggggttgtccgtacagttacaataaatgcggatggcgtgaagaggaacttttaccctggcgacaagctacccctgtggcacgacgagctggaaccccagaactcgttgcttgatattcttgctgctgggaaccctgatcccatggtgcagtga

SEQ ID NO: 486 - protein, 293 aa, Zea mays
MYAGEQTKRYAAALNRDHHRSASPRLASRRLTSPRRLGFCTAVDLAVPAMDVSHAGSSVAGEAPTTGEHRMGTTIVGVCYEGGVVLGADSRTSTGMYVANRASDKITQLTDNVYVCRSGSAADTQVISDYVRYFLHQHTIQLGQPATVKVAANLIRLLAYQNKNMLQAGMIVGGWDKYEGGQIFSVPLGGTILKQPFAIGGSGSSYLYALLDHEWKEGMSQEEAEKFVVKVVSLAMARDGASGGVVRTVTINADGVKRNFYPGDKLPLWHDELEPQNSLLDILAAGNPDPMVQ

SEQ ID NO: 487 - DNA, 495 bp, Zea mays
  CDS (1)..(495)
atgttcccgctccgatcgacctgctccctccccaccaccgagcccatggcggaccagctcaccgacgaccagatcgccgagttcaaggaggccttcagcctcttcgacaaggacggggatggttgcatcacgaccaaggagctgggcactgtcatgcgctcgctggggcaaaatcctacagaggctgagctccaggacatgatcaacgaggtcgatgctgatggcaacggcaccatcgatttcccagagtttctcaaccttatggctcgcaagatgaaggacaccgactctgaggaagagctcaaggaggccttccgtgtgtttgacaaggaccagaacggcttcatctcggccgccgagctccgccatgtcatgacaaatcttggtgagaagctaactgatgaggaggtggacgagatgatccgtgaggctgatgtcgatggtgatggccagatcaactacgaggagtttgtcaaggtcatgatggccaagtga

SEQ ID NO: 488 - protein, 164 aa, Zea mays
MFPLRSTCSLPTTEPMADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 489 - DNA, 807 bp, Zea mays
  CDS (1)..(807)
atgctcggccttcttctcctccgaggcggcaacgacgggctcgacggcctccgcgacgatgcgagcgttggcctcgatggactcggggatcggctcgtgggcgtcgcgcagcttctggatgtcgagcttgggagtgcggatcaccttcaccttggagaacttgacgtcacgcagggggaggatggcgttgcagcgcttgtgcagggcatcgacgagcacgtcgttggtcagcagaacgacggcctggttgatgtcagccttgccgagcttgttctggatgatcttcgccatgcggtggcgcacccacttctcaaggcgggtcttcgagtagcagttcttcgacagctgaccgggctgcttcttggtgaagcacgtcacgaacaggcgcagaacgtagccgtcggcggtcttcgcctcgacgggggcctcgatgagggtgcaccacttgcggagcatggagcggaccttgtcggtcgtgagggacagcgagtggaactgggtcaacaggttgcggccatcgacttcctggacctcgaacttgagcttacggaaagcctggtccttgttgtgcgcgccctcgaggtcagcctggttgacctcgtacacacggccgcgcaggttgtcagcggcgatcttcaagccctgagtcttgttgcagatcgtcttggcgaactggcggttcttgaaggtgttgggggcaacgacgtcgtaccactccttgcgggtcatgggctcctgaatcttcttcttggcgccgcggcgaccgcccttggaaacgcgagggttcttaccaacagccattattga

SEQ ID NO: 490 - protein, 268 aa, Zea mays
MLGLLLLRGGNDGLDGLRDDASVGLDGLGDRLVGVAQLLDVELGSADHLHLGELDVTQGEDGVAALVQGIDEHVVGQQNDGLVDVSLAELVLDDLRHAVAHPLLKAGLRVAVLRQLTGLLLGEARHEQAQNVAVGGLRLDGGLDEGAPLAEHGADLVGREGQRVELGQQVAAIDFLDLELELTESLVLVVRALEVSLVDLVHTAAQVVSGDLQALSLVADRLGELAVLEGVGGNDVVPLLAGHGLLNLLLGAAATALGNARVLTNSHY

SEQ ID NO: 491 - DNA, 849 bp, Zea mays
  CDS (1)..(849)
atgacgaggcgccgacaactctctctaccgtccgacaccccaagcaccagcgcggcggcggcgaccatggctgtcggaaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttggggtatgaattttaccactgataaactgagatccctagtgaagaagtggcagacattaatcgaagcccatgttgatgtcaagacaaccgacaactacatgttgcgtttgttctgcatcggcttcacgaagaggcgcccaaaccaggtcaagagaacctgctatgctcaggcatcccagatccgtcagatccgccgtaagatggttgagattatgatcaaccaggcttctacatgtgacctgaaagaacttgtttcgaagttcattccagaagttattggtaaggagattgagaagtctacctccagcatcttcccacttcaaaacgtcttcatccgcaaggtgaagatactcaaggcccccaagttcgatcttgggaagctcatggaggttcatggcgactacaaagaggatgttggtgtgaagcttgagagggctgtcgagggagatgaggctgtgcaggaggttgctgctgccgagtga

SEQ ID NO: 492 - protein, 282 aa, Zea mays
MTRRRQLSLPSDTPSTSAAAATMAVGKNKRISKGKKGGKKKTVDPFSKKDWYDIKAPSVFSVRNIGKTLVSRTQGTRIASEGLKHRVFEVCLADLQGDEDQAYRKIRLRAEDVQGRNVLTNFWGMNFTTDKLRSLVKKWQTLIEAHVDVKTTDNYMLRLFCIGFTKRRPNQVKRTCYAQASQIRQIRRKMVEIMINQASTCDLKELVSKFIPEVIGKEIEKSTSSIFPLQNVFIRKVKILKAPKFDLGKLMEVHGDYKEDVGVKLERAVEGDEAVQEVAAAE

SEQ ID NO: 493 - DNA, 1644 bp, Zea mays
  CDS (1)..(1644)
atgtctttctttctccccctcccctcccctcccctgcgggcttctctcacgagctcccccggcctcgccgccgccgcctgctccggcgggcgggacccagctcgcagcgtctcccctgcggcgaggtacacgatggagggagcgggaagagatgccaaccctttgagcggttacagaattggcaaaaccctgggaattgggtcgttcggtaaagtgaagatcgcggaacatatattgactggtcataaggtggcgatcaagatcctcaatcgccggaagatcagaagcatggaaatggaagagaaagtgaagagagaaatcaagatactgagattatttatgcatcctcatatcatacgcctttatgaggtgatagatacacctgctgatatttgtgttgttatggagtatgttaaatctggagagttgtttgattacatcgttgagaagggaaggctacacgaagaggaagcccggcacttttttcagcagatcatatctggtgttgaatattgccataggaacatggttgctcaccgtgatttaaagccagagaaccttcttttggattcaaaatgcaatgttaagattgccgattttggcttaagtaatattatgcgtgatggtcactttcttaagacgagttgtggtagcccgaattatgcagcacctgaggtcatatctggtaaactatatgctggtcctgaagttgatgtctggagctgtggagttattctttatgctcttctttgtggcactctcccatttgacgatgagaatattccaaacctttttaagaaaataaagggtggaatatatacccttcctagtcatttgtcaccttcagcgagggacttgattcccagaatgctggttgttgatccaatgaaaaggattacaatacgtgaaatccgtgaacatgtgtggttcaagatccaacttccgcgctatttggctgtaccgcctccagacactgctcaacaagttaaaaagctggacgaggaaactcttaatgatgttattaagatgggttttgacaagaatcagctaattgaatctctgcaaaacagattgcagaatgaggcaacagttgcctattatttactcttggacaataggcttcgtacaaccagtggttatcttggatctgagtttcaagaatctatggactcatctttctctcaagtaatcgctgaaacaccaacttcagcaactgaacttcggcagcatgtgtttacagaatctccaggttctggcttgaggcagcattttgcagctgaaaggaaatgggcccttggtcttcagtctcgagcacatccacgagaaataataagtgaagtgcttaaagctctgcaagaactgaatgtttactggaaaaagattggacactacaacatgaaatgcagatggagtcctggctgccttgagagtatgatgcataactgtgatggctttagtgcagagtctgctataattgaaactgatgatctcatagcgaaatcaacccgtatagtgaagtttgagattcagctttacaaaacgagggatgagaagtaccttcttgacctgcaaagggtcagtggaccacaactcctctttctggacttgtgttccgcctttctaacgcagctgagagttctttga

SEQ ID NO: 494 - protein, 547 aa, Zea mays
MSFFLPLPSPPLRASLTSSPGLAAAACSGGRDPARSVSPAARYTMEGAGRDANPLSGYRIGKTLGIGSFGKVKIAEHILTGHKVAIKILNRRKIRSMEMEEKVKREIKILRLFMHPHIIRLYEVIDTPADICVVMEYVKSGELFDYIVEKGRLHEEEARHFFQQIISGVEYCHRNMVAHRDLKPENLLLDSKCNVKIADFGLSNIMRDGHFLKTSCGSPNYAAPEVISGKLYAGPEVDVWSCGVILYALLCGTLPFDDENIPNLFKKIKGGIYTLPSHLSPSARDLIPRMLVVDPMKRITIREIREHVWFKIQLPRYLAVPPPDTAQQVKKLDEETLNDVIKMGFDKNQLIESLQNRLQNEATVAYYLLLDNRLRTTSGYLGSEFQESMDSSFSQVIAETPTSATELRQHVFTESPGSGLRQHFAAERKWALGLQSRAHPREIISEVLKALQELNVYWKKIGHYNMKCRWSPGCLESMMHNCDGFSAESAIIETDDLIAKSTRIVKFEIQLYKTRDEKYLLDLQRVSGPQLLFLDLCSAFLTQLRVL

SEQ ID NO: 495 - DNA, 480 bp, Zea mays
  CDS (1)..(480): n means a or g or c or t/u
atgccagtgcctcttcggtcaaaatatccttgtacctgcatctcgacctcaccggcgancggcggtggtatcacgatggtggcgttgctgggccggcggatcggggtggctgcggcagctgccgcgttcatcgccctcgtggcgttcggatccgcctcatcctcgcccaagtccttcgtgaagtccaccgtctccgcccacgacgtcgtcatcttctccaagtcatactgcccgtactgcaaaagagcaaaggccgtgtttaaggagcttgagttgaagaaagagccatatgttgtggagcttgatcagcgagaggatggctcagagattcaggatgccttacttgagatagttggcaggcgtactgtccctcaagtttttgtccatggaaagcacctgggtggttctgacgatactgttgactcctacgaaagtggaaaactggctagacttctaaacatcggagtcaaggacgactga

SEQ ID NO: 496 - protein, 159 aa, Zea mays
  misc_feature (20)..(20): Xaa can be Asn or Thr or Ser or Ile
MPVPLRSKYPCTCISTSPAXGGGITMVALLGRRIGVAAAAAAFIALVAFGSASSSPKSFVKSTVSAHDVVIFSKSYCPYCKRAKAVFKELELKKEPYVVELDQREDGSEIQDALLEIVGRRTVPQVFVHGKHLGGSDDTVDSYESGKLARLLNIGVKDD

SEQ ID NO: 497 - DNA, 1401 bp, Zea mays
  CDS (1)..(1401)
atgagcttcggcttctccaagcacttcttcgcaaagtacgacctcggcgaggaggtcggccgcggtcacttcggctacacgtgctccgccaaggccaagaagggcgagcacaggggccaggacgtagccgtcaaggtcatccccaaggccaagatgacaacagctatcgccattgaagatgtgagaagagaagtgagaatattgagttctctgacaggccacagtaatttagtgcagttctacgatgctttcgaggatgaagataacgtgtatatagttatggaattatgtaaaggaggtgaactgctggacaggatattggctagaggtggaaagtactctgaagaggatgcgaaggtcgttatggtacaaattttgagtgttgtatcattttgccatcttcaaggtgttgttcaccgtgatctgaaaccagagaatttccttttctcttcaaaggatgaaaactctcccttgaaggtcatagattttggcttgtctgactttgtgaagccagatgaaagactaaacgacattgttggaagcgcatactatgttgctccagaggtcctccacagatcttatgccaccgaggcagatatgtggagcattggagtaattgcctacatcttgctctgtgggagtaggcctttctgggcgcgcacggagtcgggaatcttccgagctgtcttgaaggcggaaccgagttttgatgaggccccatggcccactctcacggctgaagctaaagattttgtaaaaaggcttcttaacaaggattaccgcaagagaatgacggctgcacaagctctcagtcatccatggatccgtaattctcaacaagtgaaggttcctttggatatgataatctataagctaatgagagcgtacatcagctcgtcttcgctgcggaagtctgctttgagggccctagccaagacgctgacgacggaccaactcttttatgtaagggagcagtttgaactgctgggcccaaacaagaatggctatatctcattgcaaaatctgaaatcggctttagcgaagaactccacggatgcgatgaaggactccagggttgtcgactttgttaacacggtgtgcactcttcagtacaggaagctggacttcgaagagttcgccgcttccgccatcagcgtttaccagatggaagccttggagacctgggagcagcacgcgcggcgtgcgtacgagctgttcgacaaggaaggaaaccggcccattgtgatcgaagaacttgcgtcggaactcgggcttggcccgtcagtgcctctccacgttgtcctccaagactgggtcagacacgccgacgggaagctgagcttcctggggttcatcaagctcttgcacggggtctcgtcgcgctcgatcccaaaggcctga

SEQ ID NO: 498 - protein, 466 aa, Zea mays
MSFGFSKHFFAKYDLGEEVGRGHFGYTCSAKAKKGEHRGQDVAVKVIPKAKMTTAIAIEDVRREVRILSSLTGHSNLVQFYDAFEDEDNVYIVMELCKGGELLDRILARGGKYSEEDAKVVMVQILSVVSFCHLQGVVHRDLKPENFLFSSKDENSPLKVIDFGLSDFVKPDERLNDIVGSAYYVAPEVLHRSYATEADMWSIGVIAYILLCGSRPFWARTESGIFRAVLKAEPSFDEAPWPTLTAEAKDFVKRLLNKDYRKRMTAAQALSHPWIRNSQQVKVPLDMIIYKLMRAYISSSSLRKSALRALAKTLTTDQLFYVREQFELLGPNKNGYISLQNLKSALAKNSTDAMKDSRVVDFVNTVCTLQYRKLDFEEFAASAISVYQMEALETWEQHARRAYELFDKEGNRPIVIEELASELGLGPSVPLHVVLQDWVRHADGKLSFLGFIKLLHGVSSRSIPKA

SEQ ID NO: 499 - DNA, 594 bp, Zea mays
  CDS (1)..(594): n means a or g or c or t/u
atgtctgatctcgacattcagatcccaactgccttcgatcccttcgctgaggccaatgctggggactctggtgcagcagcagggtcaaaggactacgttcacgtgcgcatccagcagcgtaatggtcgcaagagcctgaccaccgtccagggattgaagaaggagttcagctacagcaagatcctcaaagatctcaagaaagagttctgctgcaatggtacagtggtccaggacccagaacttggacaggtcattcagctccagggtgatcagaggaagaacgtctcgaatttcctcgtccaggccggcattgtgaagaaggagcacatcaagattcatgngtttctgagcaaccgccgggtccatatcaaaccaaccctgcatgcagggcatcttattatatataatatangaggtggagcatatctatctggctgtgtactgcaagcaggcnctagtacgccgcctgcgcgttcctcctattacacatataggcccctccctgcgtgtatgcttgttaccgtcgtgtcgaaccttgtactacgaggctccatcgaacatcgatggcttgcttctttatcagaacatgtttga

SEQ ID NO: 500 - protein, 197 aa, Zea mays
  misc_feature (114)..(114): Xaa can be Ala or Glu or Gly or Val
  misc_feature (138)..(138): Xaa can be any amino acid
  misc_feature (152)..(152): Xaa can be Thr or Ala or Pro or Ser
MSDLDIQIPTAFDPFAEANAGDSGAAAGSKDYVHVRIQQRNGRKSLTTVQGLKKEFSYSKILKDLKKEFCCNGTVVQDPELGQVIQLQGDQRKNVSNFLVQAGIVKKEHIKIHXFLSNRRVHIKPTLHAGHLIIYNIXGGAYLSGCVLQAGXSTPPARSSYYTYRPLPACMLVTVVSNLVLRGSIEHRWLASLSEHV

SEQ ID NO: 501 - DNA, 1047 bp, Zea mays
  CDS (1)..(1047)
atgggccgccgcctctcctactgcatctccctcgctctcgtcgcctcgttcgcttcgcctcctccccgccccgccccgagccgagcagagcgcagccctatccggagctgggatggcggacgcgaagcagcagcagcagcagagcagcagccacagcaggcggcagcggcagccaccggcgtgtggaagacggtcaagcccttcgttaacggcggggcctctgggatgctcgcgacctgcgtcatccagcctatcgacatggtcaaggtgaggatccagttgggtgagggctctgctggtcaggtcacaaggaacatgcttgcaaatgagggtgtccgttctttctacaagggtttgtccgccggattgctgaggcaagcgacgtacacgactgctcgtcttggatcctttagggttctaactaacaaagcagttgaaaagaatgaagggaagccattgcctctatttcagaaagcttttattggtctgactgctggtgcaattggtgcttgtgttggtagtcctgctgatctggcactcattagaatgcaagccgattcgaccctgccagttgcacaacgacgcaactataagaatgctttccatgcactctaccgtatcagtggtgatgagggagtccttgcgctttggaagggtgcaggtccaactgtggtgagagctatggcactcaatatgggtatgcttgcttcctatgaccagagtgtcgagctatttagggacaaatttggcgcaggagaaatttctactgttgttggagccagcgctgtttctggattctttgcctcagcatgcagtttgccctttgactatgtgaagacacagattcagaagatgcaacctgatgcgaatggcaagtacccatacacagggtctttggactgtgctgtgaagaccttcaagagcggtggcccattcaagttctacactggtttcccggtgtactgcgtcaggattgcaccccatgtcatgatgacctggatattcttgaatcagatccagaagtttgagaagaagatcggcatatga

SEQ ID NO: 502 - protein, 348 aa, Zea mays
MGRRLSYCISLALVASFASPPPRPAPSRAERSPIRSWDGGREAAAAAEQQPQQAAAAATGVWKTVKPFVNGGASGMLATCVIQPIDMVKVRIQLGEGSAGQVTRNMLANEGVRSFYKGLSAGLLRQATYTTARLGSFRVLTNKAVEKNEGKPLPLFQKAFIGLTAGAIGACVGSPADLALIRMQADSTLPVAQRRNYKNAFHALYRISGDEGVLALWKGAGPTVVRAMALNMGMLASYDQSVELFRDKFGAGEISTVVGASAVSGFFASACSLPFDYVKTQIQKMQPDANGKYPYTGSLDCAVKTFKSGGPFKFYTGFPVYCVRIAPHVMMTWIFLNQIQKFEKKIGI

SEQ ID NO: 503 - DNA, 717 bp, Zea mays
  CDS (1)..(717)
atgttcgatcaggtcatcatcgtcatcggggaggggctgcgcagcggcagctgcaagctcagcttcatgctgctgctgcagggccatatcaatctgcacttctggtggcttcagagcaacagcttcaacaaagtgaaggttctgatcccctgccagcttcctagcgaggtaaaggaagggcttctcaaagttgtaattgctcttggcagaaatctcatagtactgcaagttcttcttccggtggaatgtaacttgcttggccttgacttgcctgttcttgacatcaaccttgttaccacaaagaacaatggggatgttctcacagaccctgcacagatccctgtgccatgtcggaacattcttgtatgtcagcctagaagtgacatcaaacataatgatggcacactgaccatgaatgtagtagccatccctaaggccaccgaacttttcttgcccagcagtgtcccagcaataaaagcgaattttgccacagttagtgctaaaatccagagggtgaacttcaacaccaatggtgggctcatatttcttctcaaactcgccagtaagatgccttttcacaaatgtggttttaccagttccaccgtcgccaacgatgacgagcttgaagctggggtaatccacgccctgctgattcggcagcgccatttctacggcgcgaagaggagtatggtacggggcggcggtgaacagagatga

SEQ ID NO: 504 - protein, 238 aa, Zea mays
MFDQVIIVIGEGLRSGSCKLSFMLLLQGHINLHFWWLQSNSFNKVKVLIPCQLPSEVKEGLLKVVIALGRNLIVLQVLLPVECNLLGLDLPVLDINLVTTKNNGDVLTDPAQIPVPCRNILVCQPRSDIKHNDGTLTMNVVAIPKATELFLPSSVPAIKANFATVSAKIQRVNFNTNGGLIFLLKLASKMPFHKCGFTSSTVANDDELEAGVIHALLIRQRHFYGAKRSMVRGGGEQR

SEQ ID NO: 505 - DNA, 543 bp, Zea mays
  CDS (1)..(543)
atggggttcgtcggagacacgatggagtcgatccgctccatgcagatccgccaagtgctcatgcagatcatcagcctcggtatgattgttacctctgcattaatcatatggaagggtttgatagttttcacggggagcgagtcaccagttgtagtggtgctctcgggtagcatggagcctggatttaaaaggggtgatatcctgtttttgcatatgagcaaagatcctattcgcacaggagaaatagttgttttcaatgtcgatggtcgtgagattccaattgtccaccgagtgattaaggtccatgaacgtcaggacactgcagaagtggacatcctcaccaaaggtgacaataattttggggatgaccgactattatatgcacatggccagctttggctccagcaacaccacattatgggacgtgcggtgggctaccttccatatgttggctgggttacaattatcatgactgagaaaccatttattaagtacctgctgattggcgcactgggcttgctggtcataacgtcgaaagattga

SEQ ID NO: 506 - protein, 180 aa, Zea mays
MGFVGDTMESIRSMQIRQVLMQIISLGMIVTSALIIWKGLIVFTGSESPVVVVLSGSMEPGFKRGDILFLHMSKDPIRTGEIVVFNVDGREIPIVHRVIKVHERQDTAEVDILTKGDNNFGDDRLLYAHGQLWLQQHHIMGRAVGYLPYVGWVTIIMTEKPFIKYLLIGALGLLVITSKD

SEQ ID NO: 507 - DNA, 378 bp, Zea mays
  CDS (1)..(378): n means a or g or c or t/u
atgnnggtcgacttcgctgtcgacgatttcgtcgtcaccgtgggggacggtgccgtcggaaagacctgcatgctcatctcctacacatccaacactttccccactgactatgttccaactgtgttcgacaacttcagtgccaatgttgtggttgacgggagcactgtcaacttgggtctgtgggatacagcaggacaagaagattacaatagactgcgtccgttgagctatcgtggtgctgatgtttttctgctcgccttttctcttatcagcaaagcaagctatgagaatgtctctaagaagngcaataatctttccctgcccactttcttgccccggccccggtttaatgcattcttatttattttagctanttga

SEQ ID NO: 508 - protein, 125 aa, Zea mays
  misc_feature (2)..(2): Xaa can be any amino acid
  misc_feature (102)..(102): Xaa can be Ser or Arg or Gly or Cys
  misc_feature (125)..(125): Xaa can be Asn or Thr or Ser or Ile
MXVDFAVDDFVVTVGDGAVGKTCMLISYTSNTFPTDYVPTVFDNFSANVVVDGSTVNLGLWDTAGQEDYNRLRPLSYRGADVFLLAFSLISKASYENVSKKXNNLSLPTFLPRPRFNAFLFILAX

SEQ ID NO: 509 - DNA, 660 bp, Zea mays
  CDS (1)..(660): n means a or g or c or t/u
atgcgccatcagccatcgaattcgatggcggccaacttcgggaacaagatccgcaacgccaagctggttcttcttggagatgtaggcgctggcaaatctagcttggttcttcggtttgtcaagggacagtttgttgaattccaggaatcaacaatcggagcagctttcttttcccagaccttagcggtaaatgatgagactgttaagtttgaaatctgggatactgctgggcaggagaggtatcatagcttggcccccatgtattataggggtgcagccgccgccattgttgtctatgacatcacaaatccggcctccttcacccgtgccaagaaatgggttcaagaacttcaagctcaaggaaatccgaatacaatagtggctcttgctggtaacaaggttgatatgctagatgcgaggcacgtggcagtagaggaagcaaagacgtatgcccaggagaacggtctcttcttcatggagacatctgctaaaactgcaatcaatgtgaatgacatattttatgagattgcaaagagattgcttcaagggcaagaggctccaagtccacaggctggaattgttctgaatcagagaccagatgnagaggatggtcagcacttcctcgtgctgctcatgaagctgtgtttcaacctcatatga

SEQ ID NO: 510 - protein, 219 aa, Zea mays
  misc_feature (201)..(201): Xaa can be Ala or Glu or Gly or Val
MRHQPSNSMAANFGNKIRNAKLVLLGDVGAGKSSLVLRFVKGQFVEFQESTIGAAFFSQTLAVNDETVKFEIWDTAGQERYHSLAPMYYRGAAAAIVVYDITNPASFTRAKKWVQELQAQGNPNTIVALAGNKVDMLDARHVAVEEAKTYAQENGLFFMETSAKTAINVNDIFYEIAKRLLQGQEAPSPQAGIVLNQRPDXEDGQHFLVLLMKLCFNLI

SEQ ID NO: 511 - DNA, 924 bp, Zea mays
  CDS (1)..(924)
atgcaaaggcccccaaccccaaccttgcaggaaaagagagagagagagacgaccccccaaatcggaatccgcacacccccatccatggccgccgccctgctccgccgctcgccggcggtgcgcgcgctcctctcgccggcactctcgtcccgcctcgtcgcgtccaagccccactcctcgtcccccgcgccgccgccacctgccaaggccgcctccagcacgaagaccttctcgatctaccggtgggacccggactcgccgtcgacgaagccgcacctcaaggactaccaggtggacctgtccgactgcgggccgatggtgctggacgcgctgctcaagatcaagaacgagcaggacccgtcgctcaccttccgccgcagctgccgcgagggcatctgcgggagctgcgccatgaacatcgacggcgacaacggcctcgcctgcctcaccaagatctccgccgcctcctccgcgtccaccgtctcgccgctgccccacatgttcgtcatcaaggacctggtggtcgacatgaccaacttctacaaccagtacaagagcgtcgagccgtggctcaagcgcaaggacccgccgccgcagctaggcaaggaggtcccgcagaccaaggccgaccgcgccaagctcgacggcatgtacgagtgcatcctctgcgcctgctgctccacctcctgcccatcctactggtggaaccccgaggagtacctcggcccagccgcgctgctccacgccaataggtggatacaggacagccgtgaccagttcaccaaggagcgcctggacgccatcaacgacgagttcaagctgtaccgctgccacaccatcaagaactgcacgcatgcctgccccaagggcctgaacccggcgaagcagatcgacacgatcaagaagctccagttggacgcctga

SEQ ID NO: 512 - protein, 307 aa, Zea mays
MQRPPTPTLQEKRERETTPQIGIRTPPSMAAALLRRSPAVRALLSPALSSRLVASKPHSSSPAPPPPAKAASSTKTFSIYRWDPDSPSTKPHLKDYQVDLSDCGPMVLDALLKIKNEQDPSLTFRRSCREGICGSCAMNIDGDNGLACLTKISAASSASTVSPLPHMFVIKDLVVDMTNFYNQYKSVEPWLKRKDPPPQLGKEVPQTKADRAKLDGMYECILCACCSTSCPSYWWNPEEYLGPAALLHANRWIQDSRDQFTKERLDAINDEFKLYRCHTIKNCTHACPKGLNPAKQIDTIKKLQLDA

SEQ ID NO: 513 - DNA, 1413 bp, Zea mays
  CDS (1)..(1413)
atgggcaacaggttccgcgtcggccgcaagctggggagcggctcctttggggagatctacctcggcaccaacgtgcagaccaacgaggaggtcgcaattaaactggaaaatgttaagacgaagcatcctcaattgctttatgagtcaaaattatacagaatacttcaaggaggaactgggattccaaatgttaagtggtttggcgttgagggtgattacaatgttttggttatggacttactgggaccgagtcttgaagatctttttagcttttgcaacaggaagctgtccctcaaaactgttttgatgattgctgatcaaatgatcaatcgagttgaatttgttcattccaagtcattcttgcatagagatatcaagccggacaattttctcatgggtctcgggaaaagagcaaaccaggtttacattatcgattttggacttgcaaagaagtacagagatacatcaacacaccagcacattccatacagagagaacaagaacttgactggaacggcaagatatgcaagcgtaaatacccaccttggaattgaacaaagccgaagggatgacatggaatctcttggatatgtactgatgtacttcttgagaggaagccttccatggcagggcctgaaagctgggaacaagaaacagaagtatgaaaagatcagcgaaaggaaagttgctacttcaattgaggctctctgccgtggatatcctaccgaatttgcttcttacttccattactgtcgctcactacgctttgaagatccaccagactatcaatacctgaagagattgttcagagacctttttattcgggaaggttttcagtttgattatgtttttgactggacaattctaaagtaccaacatgcacagatgaccacggctccgccacgtgcaattgctccagcagtaggacaaagctctgggatggctcctgtggcaaacaacaatagacattcaggcactgaagagggaaggagaagcgggtggtcagacatggacccaacgcgacgccaggctccaccaccagttataaatgcaggcagcctagccaagcagaagtcgcctgttcggcctgagacatcaacatcgaaagatgctgtgttctccagttcgacttttttgggacgttcaagcggatcgtcaaggcggcctgctgtatctagtagccgagagctaagcactgaagcggagcaaacacgtagccgcacaactgacgcgagcccaggggcattccagaggtctggagctccacggtggagcccgcagatgcctgattcctcggacggcaggcgttcgtcttccagcaggcgccactcatctaaccccaagaactacgagtctaccattaggggcatgcagggcctaaactttgatggcgatgacagggtgcactattga

SEQ ID NO: 514 - protein, 470 aa, Zea mays
MGNRFRVGRKLGSGSFGEIYLGTNVQTNEEVAIKLENVKTKHPQLLYESKLYRILQGGTGIPNVKWFGVEGDYNVLVMDLLGPSLEDLFSFCNRKLSLKTVLMIADQMINRVEFVHSKSFLHRDIKPDNFLMGLGKRANQVYIIDFGLAKKYRDTSTHQHIPYRENKNLTGTARYASVNTHLGIEQSRRDDMESLGYVLMYFLRGSLPWQGLKAGNKKQKYEKISERKVATSIEALCRGYPTEFASYFHYCRSLRFEDPPDYQYLKRLFRDLFIREGFQFDYVFDWTILKYQHAQMTTAPPRAIAPAVGQSSGMAPVANNNRHSGTEEGRRSGWSDMDPTRRQAPPPVINAGSLAKQKSPVRPETSTSKDAVFSSSTFLGRSSGSSRRPAVSSSRELSTEAEQTRSRTTDASPGAFQRSGAPRWSPQMPDSSDGRRSSSSRRHSSNPKNYESTIRGMQGLNFDGDDRVHY

SEQ ID NO: 515 - DNA, 669 bp, Zea mays
  CDS (1)..(669)
atgccggcactctcgtcccgcctcgtcgcgtccaagccccactcctcgtcccccgcgccgccgccacctgccaaggccgcctccagcacgaagaccttctcgatctaccggtgggacccggactcgccgtcgacgaagccgcacctcaaggactaccaggtggacctgtccgactgcgggccgatggtgctggacgcgctgctcaagatcaagaacgagcaggacccgtcgctcaccttccgccgcagctgccgcgagggcatctgcgggagctgcgccatgaacatcgacggcgacaacggcctcgcctgcctcaccaagatctccggcgcctcctccgcgtccacggtctcgccgctgccccacatgttcgtcgtcaaggacctggtggtggacatgaccaacttctacagccagtacaagagcgtcgagccatggctcaagcgcaaggaccagcccccgcagcagggcaaggagatcccgcagaccaaggccgaccgggccaagctcgacggcatgtacgagtgcatcctctgcgcctgctgctccacctcctgcccgtcctactggtggaacccggaggagtacctcggcccggccgcgctgctccacgccaacaggtataccaccatcaccgccacatcgcatcctttgtactgtgatggatga

SEQ ID NO: 516 - protein, 222 aa, Zea mays
MPALSSRLVASKPHSSSPAPPPPAKAASSTKTFSIYRWDPDSPSTKPHLKDYQVDLSDCGPMVLDALLKIKNEQDPSLTFRRSCREGICGSCAMNIDGDNGLACLTKISGASSASTVSPLPHMFVVKDLVVDMTNFYSQYKSVEPWLKRKDQPPQQGKEIPQTKADRAKLDGMYECILCACCSTSCPSYWWNPEEYLGPAALLHANRYTTITATSHPLYCDG

SEQ ID NO: 517 - DNA, 330 bp, Zea mays
  CDS (1)..(330): n means a or g or c or t/u
atgtctgatctcgacattcagatcccaactgccttcgatcccttcgctgaggccaatgctggggactctggtgcggcagcagggtcaaaggactacgtacacgtgcgcatccagcagcgtaatggtcgcaagagcctgaccaccgtccagggattgaagaaggagttcagctacagcaagatcctcaaagatctcaagaaagagttctgctgcaatggtacagtggtccaggacccagaacttggacaggctgcccgctataggtcattcagctccagggtgatangaggaagaacgtcangaatttcctcgtccaggccggcattgtga

SEQ ID NO: 518 - protein, 109 aa, Zea mays
  misc_feature (96)..(96): Xaa can be any amino acid
  misc_feature (101)..(101): Xaa can be any amino acid
MSDLDIQIPTAFDPFAEANAGDSGAAAGSKDYVHVRIQQRNGRKSLTTVQGLKKEFSYSKILKDLKKEFCCNGTVVQDPELGQAARYRSFSSRVIXGRTSXISSSRPAL

SEQ ID NO: 519 - DNA, 246 bp, Zea mays
  CDS (1)..(246)
atgtctgatctcgacgtccagcttccatctgcttttgatccgtttgcagaggcaaatgctgatttcccccttgctggagggggggcaaaggactatgtgcacgtgcgtattcagcagcgcaacggaaggaagagtctgacaactgttcagggcttgaagaaagagtacagctacaacaagatcctcaaggatctcaaaaaagagttctgctgcaatggtactgtagtccaggatccagagctatga

SEQ ID NO: 520 - protein, 81 aa, Zea mays
MSDLDVQLPSAFDPFAEANADFPLAGGGAKDYVHVRIQQRNGRKSLTTVQGLKKEYSYNKILKDLKKEFCCNGTVVQDPEL

SEQ ID NO: 521 - DNA, 1176 bp, Zea mays
  CDS (1)..(1176)
atgggctgccctgcctcgagctcatcatgctcatcagcaagccggccggctcggtggtgtaccgccagaacgcgaggacccccgggcacgacgacggcaggcgctacaactcacgaccaagtccccactagcaaccgtccccacaatcctccgacgatgcctgccgcgccgacgctgttgcccccgtgcgacgcggaggagccgctgctggcggagtcctccgaccgcttctccatgttcccgatccgtttcccgcagatctgggagttctacaagaaggcggtggcctccttctggacggcggaggaggttgacctctctgccgacgcccggcactgggacgaggcgctgtcccccgacgagcggcacttcatctcccacgtgctcgccttcttcgctgcctccgacggcatcgtgctcgagaacctcgcttcccgcttcatgaccgacgtgcaggtcgccgaggcgcgggccttctacggcttccagatcgccatcgagaacatccactcggagatgtattcgctgctgctcgagacctacatccgcgaccacgtcgagaaggaccgcctgttccgcgccatcgacaccgtgcccgcggtccgccgcaaggctgactgggccatgcgctggatcgacggcggggagcgcttcgctgagcgcatcgttgccttcgcctgcgtcgagggcatattcttctcggggtccttctgcgccatcttctggctcaagaagcgcgggctcatgccgggcctcaccttctccaacgagctcatctcccgcgatgagggcctccactgtgatttcgcctgcctcctctacgagcttctccgcaacaagctcgacgaggcccgcgtccgcgagatcgtcgcagacgctgtcgacatcgagcgcgagttcgtctgcgacgccctccctgtcgcgctcgtcggcatgaacggggatctcatgagccagtacattgaattcgtggccgaccgcctgctcatggcgctcgggtgcaagaagatgtacaacgtgaccaatcccttcgactggatggagctcatctcgctgatggggaagaccaacttcttcgagaagcgcgtgggtgactaccagaaggcatccgtcatgaacagcctcaacggcggcggcgctgccgaccacgtcttcagcatcgacgaggacttctga

SEQ ID NO: 522 - protein, 391 aa, Zea mays
MGCPASSSSCSSASRPARWCTARTRGPPGTTTAGATTHDQVPTSNRPHNPPTMPAAPTLLPPCDAEEPLLAESSDRFSMFPIRFPQIWEFYKKAVASFWTAEEVDLSADARHWDEALSPDERHFISHVLAFFAASDGIVLENLASRFMTDVQVAEARAFYGFQIAIENIHSEMYSLLLETYIRDHVEKDRLFRAIDTVPAVRRKADWAMRWIDGGERFAERIVAFACVEGIFFSGSFCAIFWLKKRGLMPGLTFSNELISRDEGLHCDFACLLYELLRNKLDEARVREIVADAVDIEREFVCDALPVALVGMNGDLMSQYIEFVADRLLMALGCKKMYNVTNPFDWMELISLMGKTNFFEKRVGDYQKASVMNSLNGGGAADHVFSIDEDF

SEQ ID NO: 523 - DNA, 1794 bp, Zea mays
  CDS (1)..(1794)
atgttcagtcgccgtcgcggcgccgcgcgggagcccccagaaaagccgaggaggaggcatcgtacaccttctgcctcgctgcgccggcctcccaatcgatcgaggcggcgcagagcagaggaaaaccccgagccgcaaccctcctcaccgcacagcaactcgagtactcgttctcttccgcatcctcctcctcgtcaactccagtcgtcttcagcccttcaccacaatcaggcccacctcccaccaccacatttcttctcatccaaccgccccgtaggatcacagggaagggggatggcgagcggcggggcggtgagggatgtgggctcggctgcggagctggaggcggcggtggccggggcgcgggcggtggcggtgcacttctgggcgtcctggtgcgaggcgtccaagcagatggacgaggtcttcgcgcacctcgccgtcgacttcccccacgcggtcttcctccgggttgaagctgaagaacaacctgaaatatcagaggcgtatggagttacagcggtgccatattttgttttctgcaaggaaggcaaaattgtcgatactttggagggagtaaacccagccagcttggccaataaggttgcaaaagtagctgggcctgctagtgttgctgagtctgctgtacctgctagccttggagttgctgctggacctgctgtacttgaaaacatccaaaagatggcacagcgaaatggatcttctgctgttgaaagcataagctctggtagcacagaagatgcattgaataagcgattggagcagcttgtcaattcccatcccgtgtttttatttatgaagggaaccccagagcaaccaaggtgtggtttcagccgtaaagtgattgacattttgaagcaggaaggggtgaaatttgggagctttgacattcttacagacaatgatgttcgcgaaggcatgaagaaattctccaactggcccactttccctcaactctactgcaaaggcgagctgcttggtggatgtgatattgttattgctatgcatgacagtggtgaattgaaggatgtttttgaggagcacaatattcccctcaaaccacagggtagcaaaaatgaagaagcaggtcagcccgagtctgcaactgagaagggtgctgcagttgctgaaccaatggggcttactgatgctcagaaagctcgtttggaaagccttattaattccagcccagtgatggtattcatcaaaggtacaccagaggaaccaaagtgtgggttcagtgggaagttggtccacatacttaagcaagagaatattcctttctcaagttttgacatcctttcagatgatgaggttagacaggggctgaaggtgctctcaaactggcccagttaccctcaactgtacataaaaggtgagctggttggcggctcagacatagtgatggagatgcacaagagtggtgagctgaagaaggttctgtctgagaaaggggttattccaaaggaaagcctggaggacagattgaagtccctggtttcctctgcaccggtgatgcttttcatgaagggcactccagatgctcctcgttgcggcttcagttcgaaggttgtgaacgccttgaagaaggaaggggtcagctttgggtccttcgacatcttatctgacgaggaagttaggcaaggtttgaagacgtactccaactggcctaccttcccccagctctactacaaatcggagctgattgggggatgtgatatcgttcttgagatggagaagagcggagagctgaagtcgaccctgtcagagtga

SEQ ID NO: 524 - protein, 597 aa, Zea mays
MFSRRRGAAREPPEKPRRRHRTPSASLRRPPNRSRRRRAEENPEPQPSSPHSNSSTRSLPHPPPRQLQSSSALHHNQAHLPPPHFFSSNRPVGSQGRGMASGGAVRDVGSAAELEAAVAGARAVAVHFWASWCEASKQMDEVFAHLAVDFPHAVFLRVEAEEQPEISEAYGVTAVPYFVFCKEGKIVDTLEGVNPASLANKVAKVAGPASVAESAVPASLGVAAGPAVLENIQKMAQRNGSSAVESISSGSTEDALNKRLEQLVNSHPVFLFMKGTPEQPRCGFSRKVIDILKQEGVKFGSFDILTDNDVREGMKKFSNWPTFPQLYCKGELLGGCDIVIAMHDSGELKDVFEEHNIPLKPQGSKNEEAGQPESATEKGAAVAEPMGLTDAQKARLESLINSSPVMVFIKGTPEEPKCGFSGKLVHILKQENIPFSSFDILSDDEVRQGLKVLSNWPSYPQLYIKGELVGGSDIVMEMHKSGELKKVLSEKGVIPKESLEDRLKSLVSSAPVMLFMKGTPDAPRCGFSSKVVNALKKEGVSFGSFDILSDEEVRQGLKTYSNWPTFPQLYYKSELIGGCDIVLEMEKSGELKSTLSE

SEQ ID NO: 525 - DNA, 768 bp, Zea mays
  CDS (1)..(768): n means a or g or c or t/u
atgcgctgtcgacgatttcgtccaggtaggtgtggctggctcgtgcagcggcgganggcggcagtgagagcgatgagcgcggcggcggcgaantcggtcaccaagttcatcaagtgcgtcacggtcggcgatggggccgtcgggaagacctgcatgctcatctgctacacctgcaacaagttccccacggattatatccccaccgtatttgacaacttcagcgccaatgtctccgtgggtgggagcatcgttaacttgggcctctgggacacggcaggccaggaggattacagcaggttgaggcctctcagctacaggggtgccgatgtgttcatcctctccttctccctggtcagcagggcgagctatgagaacgtcctcaagaagtggatgccagagcttcgccgattttcacctactgttcctgtagttcttgttggaaccaaactagatctccgtgaagacagatcttaccttgctgaccattctgctgcttccatcatctctactgaacagggagaagagctcaggaagcagataggcgctgtggcgtacatagaatgcagctcaaagacacagaggaacgtaaaggctgtgttcgacactgcaattaaagtagtgctngcaaccaccgaggagaagagaagttaccaggaagaaaatgaaggcaaggtcgaatcagtctctgagaagatacctctgtggaagcggatgtttcacatcgtaaagcacaggctcttctgcgactgttgtactggactggcttga

SEQ ID NO: 526 - protein, 255 aa, Zea mays
  misc_feature (19)..(19): Xaa can be Lys or Thr or Arg or Met
  misc_feature (31)..(31): Xaa can be Lys or Asn
MRCRRFRPGRCGWLVQRRXAAVRAMSAAAAXSVTKFIKCVTVGDGAVGKTCMLICYTCNKFPTDYIPTVFDNFSANVSVGGSIVNLGLWDTAGQEDYSRLRPLSYRGADVFILSFSLVSRASYENVLKKWMPELRRFSPTVPVVLVGTKLDLREDRSYLADHSAASIISTEQGEELRKQIGAVAYIECSSKTQRNVKAVFDTAIKVVLATTEEKRSYQEENEGKVESVSEKIPLWKRMFHIVKHRLFCDCCTGLA

SEQ ID NO: 527 - DNA, 369 bp, Zea mays
  CDS (1)..(369): n means a or g or c or t/u
atgcttattagtgttctgtttgcatctgatggtatggcatcatctttgatagatccgtttgctgaggcaaatgctgaggactctggtgctggtcctggaacgaaggattatgtgcatgtgcgcatccagcagcgcaacggcagaaagagtctgactacagtccagggtctgaagaaagagttcagctataacaagatcctcaaggatctgaagaaggaattctgctgcaatggtactgtagttcaggacccagagctaggccaggtaagatacgagaacaatgcatttcaagcttgtaaaaatggtatctgccggttggtggatatactgatangtttgtccgctgcaggtcattcagctccaaggtga

SEQ ID NO: 528 - protein, 122 aa, Zea mays
  misc_feature (112)..(112): Xaa can be Arg or Cys or Ser or Gly
MLISVLFASDGMASSLIDPFAEANAEDSGAGPGTKDYVHVRIQQRNGRKSLTTVQGLKKEFSYNKILKDLKKEFCCNGTVVQDPELGQVRYENNAFQACKNGICRLVDILIXLSAAGHSAPR

SEQ ID NO: 529 - DNA, 459 bp, Zea mays
  CDS (1)..(459): n means a or g or c or t/u
atgctcttggagcgcaccaacaccacccggagaccggagcgactcgccaccggcgcggaaaaggagggcggaggctcgatggcggatgagaatcaggctggaaagaaagaggaggaggaatttagcacaggccctctgtcagtcctaatgatgagtgttaagaacaacacccaggtcctcatcaattgccgcaacaacaagaagctacttggccgtgttcgtgcttttgatcgccactgtaacatggtgctcgagaacgtgcgtgagatgtggacagagatccccaagactggcaagggcaaaaagaaggctctgcctgtgaacaaggatagattcatcagtaagatgttcctcaggggcgactcggtcatcantagtgttgaggaacccgaagtgatcgcccaaccagtcaccttgcagcagttatgccctttctctgggttcacggaatccgtgtga

SEQ ID NO: 530 - protein, 152 aa, Zea mays
  misc_feature (125)..(125): Xaa can be Asn or Thr or Ser or Ile
MLLERTNTTRRPERLATGAEKEGGGSMADENQAGKKEEEEFSTGPLSVLMMSVKNNTQVLINCRNNKKLLGRVRAFDRHCNMVLENVREMWTEIPKTGKGKKKALPVNKDRFISKMFLRGDSVIXSVEEPEVIAQPVTLQQLCPFSGFTESV

SEQ ID NO: 531 - DNA, 1179 bp, Zea mays
  CDS (1)..(1179)
atggtgcgggctcgtctccatcgcccgccacccgctccgtcgtcgttcgtccccgccgcgccgatcccgaatcgaatggggagcctggcgtccgagaggaaggtggtcgggtgggccgccagggacgccaccggacacctctccccctactcctacaccctcaggaacacaggccctgaagatgtggtggtgaaggtgctctactgcgggatctgccacacggacatccaccaggcaaagaaccacctcggggcttcaaagtatcctatggtccctgggcacgaggtggtcggcgaggtggtggaggtcgggcccgaggtggccaagtacggcgtcggcgacgtggtaggcgtcggggtgatcgttgggtgctgccgcgagtgcagcccctgcaaggccaacgttgagcagtactgcaacaagaagatctggtcatacaacgacgtctacactgatggacggcccacgcagggtggattcgcctccaccatggtcgtcgaccagaagtttgtggtgaagatcccggcaggtctggctccggagcaagcggcgccgctgctgtgcgctggcgtgacggtgtacagcccgctgaagcactttgggctgacgaccccgggcctccgtggcggcatcctgggcctcggcggcgtgggccacatgggcgtgaaggtagccaaggccatgggccaccacgtgacggtgatcagctcgtcgtccaagaagcgcgcggaggcaatggaccacctcggcgcggacgcgtacctagtgagctcggacgccgcggccatggggccggccgccgactcgctggactacatcatcgacacggtgcccgtgcaccacccgctggagccgtacctggcgctgctgaagctggacggcaagctcgtgctgctgggcgtcatcggcgagcccctgagcttcgtgtcgcccatggtgatgctggggcggaaggccatcacggggagcttcatcggcagcatcgacgagaccgctgaggtgcttcagttctgcgtcgacaaggggctcacctcccagatcgaggtggtcaagatggggtacgtgaacgaggcgctggagcggctggagcgcaacgacgtccgctaccgcttcgtcgtcgacgtcgccggtagcaacgtcgaggcggaggcggcggcggcggatgcggccagcaactga

SEQ ID NO: 532 - protein, 392 aa, Zea mays
MVRARLHRPPPAPSSFVPAAPIPNRMGSLASERKVVGWAARDATGHLSPYSYTLRNTGPEDVVVKVLYCGICHTDIHQAKNHLGASKYPMVPGHEVVGEVVEVGPEVAKYGVGDVVGVGVIVGCCRECSPCKANVEQYCNKKIWSYNDVYTDGRPTQGGFASTMVVDQKFVVKIPAGLAPEQAAPLLCAGVTVYSPLKHFGLTTPGLRGGILGLGGVGHMGVKVAKAMGHHVTVISSSSKKRAEAMDHLGADAYLVSSDAAAMGPAADSLDYIIDTVPVHHPLEPYLALLKLDGKLVLLGVIGEPLSFVSPMVMLGRKAITGSFIGSIDETAEVLQFCVDKGLTSQIEVVKMGYVNEALERLERNDVRYRFVVDVAGSNVEAEAAAADAASN

SEQ ID NO: 533 - DNA, 666 bp, Zea mays; identical to SEQ ID NO: 229
  CDS (1)..(666)

SEQ ID NO: 534 - protein, 221 aa, Zea mays; identical to SEQ ID NO: 230

SEQ ID NO: 535 - DNA, 348 bp, Zea mays; identical to SEQ ID NO: 423
  CDS (1)..(348)

SEQ ID NO: 536 - protein, 115 aa, Zea mays; identical to SEQ ID NO: 424

SEQ ID NO: 537 - DNA, 462 bp, Zea mays
  CDS (1)..(462): n means a or g or c or t/u
atgcacaacagggggcgagggaggagttgttggagtcaggaatggcagatacattgggggtttctgctgatcaanaggtcaagattgctcagggcaaccgagaganagaaccaaacaactgataggctcagagatagccatagaactatgctggagactgaagaacttggtgtctctatcctgcatgacctgagtcaacagcgccagtctctcttgcatgctcatgatgtattggacgaggtggataacaacgtcggcaagagcaggaggaccattggaggcatgatgaggagaatggatagaaacaagtggatcatcggtctcatcatagcagttcttgtcttggctatcctcgtgattctgtatttcaagttcgtgcactantggattgcgttgcgtacgttgcatggacnggtacgtagttttctactgcgaccagaacgaagaggaaggcagctgtga

SEQ ID NO: 538 - protein, 153 aa, Zea mays
  misc_feature (25)..(25): Xaa can be Lys or Asn
  misc_feature (36)..(36): Xaa can be any amino acid
  misc_feature (128)..(128): Xaa can be any amino acid
  misc_feature (138)..(138): Xaa can be Arg or Gln or Leu or Pro
MHNRGRGRSCWSQEWQIHWGFLLIXRSRLLRATERXNQTTDRLRDSHRTMLETEELGVSILHDLSQQRQSLLHAHDVLDEVDNNVGKSRRTIGGMMRRMDRNKWIIGLIIAVLVLAILVILYFKFVHXWIALRTLHGXVRSFLLRPERRGRQL

SEQ ID NO: 539 - DNA, 396 bp, Zea mays
  CDS (1)..(396)
atgagtgatagtggtggtgaaaaggagaaatcatccaagaaggaagcaagcagttcaaagccagttcagaaaagaaagcataaggccagggatgacgaaggacaagagaagaaaaagccaaagaagaaaaaagatccgaatgctccgaaacgagccatgaccccgttcatgtatttctcaatggctgagcgaggaaacatgaagagcagcaacccagatttgcctacgactgagatcgcaaagaagcttggggagatgtggcaaaagatgtcaggcgaagagaaacagccttacatccagcaggcccaggtcgacaagaagcgttatgaaaaagaatccgctgtctatcgcggtgaagctacagtcgatgtggattctgggaacgagtctgactga

SEQ ID NO: 540 - protein, 131 aa, Zea mays
MSDSGGEKEKSSKKEASSSKPVQKRKHKARDDEGQEKKKPKKKKDPNAPKRAMTPFMYFSMAERGNMKSSNPDLPTTEIAKKLGEMWQKMSGEEKQPYIQQAQVDKKRYEKESAVYRGEATVDVDSGNESD

SEQ ID NO: 541 - DNA, 348 bp, Zea mays
  CDS (1)..(348)
atgtctgatctcgacgtccagcttccatctgcctttgatccgtttgctgaggcaaatgctgaggactctggtgctggtcctggaacgaaggattatgtgcatgtgcgcatccagcagcgcaacggcagaaagagtctgactacagtccagggtctgaagaaagagttcagctataacaagatcctcaaggatctgaagaaggaattctgctgcaatggtactgtagttcaggacccagagctaggccaggtcattcagctccaaggtgaccagcgcaagaatgttgctactttcctagttcaggctgggattgcgaagaaagagaacatcaagattcacgggttctga

SEQ ID NO: 542 - protein, 115 aa, Zea mays
MSDLDVQLPSAFDPFAEANAEDSGAGPGTKDYVHVRIQQRNGRKSLTTVQGLKKEFSYNKILKDLKKEFCCNGTVVQDPELGQVIQLQGDQRKNVATFLVQAGIAKKENIKIHGF

SEQ ID NO: 543 - DNA, 822 bp, Zea mays
  CDS (1)..(822)
atgacgggctccatggatctcccggccaagggcgggttcagcttcgacctgtgccgccggaacaacatgctggagaagaacgggctcaaggtcccgggattcaggaagaccgggacaaccatcgtcggcctcgtctttcaggatggggttgttcttggggcagacacaagggcaactgagggccccatagttgctgataagaactgtgagaaaatccactttatggcaccgaatatatactgctgtggagcaggaactgctgcggacacggaggccgttacagatatggtgagctcccagctacagcttcaccgttatgcaacgggccgcgaatcaagagttgtaactgctcttacactactgaagtcacacctcttcaagtatcaaggccatgtcagtgctgcccttgttcttggtggagtggattgtactgggccacatttacacactgtttatccacacgggtccactgatactcttccttttgccaccatgggctctggttctcttgctgcaatgtcagtgtttgaatcgaagtacaaagaaggccttactagggaggagggaatacagattgtgtgcgaagcaatctgtgctggtattttcaatgacttgggtagtgggagcaacgtggacgtctgcgtgataaccaaggggaagacagaatacttgagaaaccaccagttgccgaatcccaggacttatgctagttcaaagggatacagtttcaccaaggggcagactgaggtactgtcttcaaaggtcacacttctaaagcagaaggttgaggtcgccgagggtggtgatgctatggaggagtga

SEQ ID NO: 544 - protein, 273 aa, Zea mays
MTGSMDLPAKGGFSFDLCRRNNMLEKNGLKVPGFRKTGTTIVGLVFQDGVVLGADTRATEGPIVADKNCEKIHFMAPNIYCCGAGTAADTEAVTDMVSSQLQLHRYATGRESRVVTALTLLKSHLFKYQGHVSAALVLGGVDCTGPHLHTVYPHGSTDTLPFATMGSGSLAAMSVFESKYKEGLTREEGIQIVCEAICAGIFNDLGSGSNVDVCVITKGKTEYLRNHQLPNPRTYASSKGYSFTKGQTEVLSSKVTLLKQKVEVAEGGDAMEE

SEQ ID NO: 545 - DNA, 600 bp, Zea mays
  CDS (1)..(600): n means a or g or c or t/u
atgtctgatctcgacattcagatcccaactgccttcgatcccttcgctgaggccaatgctggggactctggtgcggcagcagggtcaaaggactacgtacacgtgcgcatccagcagcgtaatggtcgcaagagcctgaccaccgtccagggattgaagaaggagttcagctacagcaagatcctcaaagatctcaagaaagagttctgctgcaatggtacagtggtccaggacccagaacttggacaggtcattcagctccagggtgatcagaggaagaacgtctcgaatttcctcgtccaggccggcattgtgaagaaggagcacatcaagattcatgngtttctgagcaaccgccgggtccatagcaaaccaaccctgcatgcagggccagcttattantatataatatctgaggtggagcatatctatctggctgtgtactgcaagcaggcnctagtacgccgcctgcgcgttcctcctattacacatataggcccctccctgcgtgtatgcttgttaccgtcgtgtcgaaccttgtactacgaggctccatcgaacatcgatggcttgcttctttatcagaacatgtttgaatga

SEQ ID NO: 546 - protein, 199 aa, Zea mays
  misc_feature (114)..(114): Xaa can be Ala or Glu or Gly or Val
  misc_feature (134)..(134): Xaa can be any amino acid
MSDLDIQIPTAFDPFAEANAGDSGAAAGSKDYVHVRIQQRNGRKSLTTVQGLKKEFSYSKILKDLKKEFCCNGTVVQDPELGQVIQLQGDQRKNVSNFLVQAGIVKKEHIKIHXFLSNRRVHSKPTLHAGPAYXYIISEVEHIYLAVYCKQALVRRLRVPPITHIGPSLRVCLLPSCRTLYYEAPSNIDGLLLYQNMFE

SEQ ID NO: 547 - DNA, 516 bp, Zea mays
  CDS (1)..(516): n means a or g or c or t/u
atgtaccccagctctacccgcgacgaagcatcaccaggaaggatgacgtgctcaatggatancccggccaagggcgggttcagcttcgacctgtgccgccgcaacagtatgctggagaagaacgggctcaaactcccgggattcaggaagaccggaacaaccatcgtcggcctcgtctttcaggatggggttgttcttggggcagacacaagagcaactgaggggcctatagttgctgataagaattgtgagaagatccactttatggcgccaaacatttattgttgtggagcaggaactgctgctgacactgaggctgttacagacatggtcagctcgcagctacagctgcaccgttacgcaacgggtcgcgaatctagagtcgtaactgctcttacactgctgaaganacatctctttaggtatcaaggccatgtcagtgctgcccttgttcttggtggagtggattgtactggaccgcatcttcacactgtttatccancacggctccactga

SEQ ID NO: 548 - protein, 171 aa, Zea mays
  misc_feature (21)..(21): Xaa can be Asn or Thr or Ser or Ile
  misc_feature (137)..(137): Xaa can be Lys or Thr or Arg or Ile
  misc_feature (168)..(168): Xaa can be Thr or Pro or Ala or Ser
MYPSSTRDEASPGRMTCSMDXPAKGGFSFDLCRRNSMLEKNGLKLPGFRKTGTTIVGLVFQDGVVLGADTRATEGPIVADKNCEKIHFMAPNIYCCGAGTAADTEAVTDMVSSQLQLHRYATGRESRVVTALTLLKXHLFRYQGHVSAALVLGGVDCTGPHLHTVYPXRLH

SEQ ID NO: 549 - DNA, 516 bp, Zea mays
  CDS (1)..(516)
atgacatggcggagctcggcggccgagatgaagccgttctggtccttgtcaaacacacggaaggcctccttgagctcttcctcagagtcggtgtccttcatcttgcgagccataaggttgagaaactctgggaaatcgatggtgccgttgccatcagcatcgacctcgttgatcatgtcctggagctcagcctctgtaggattttgccccagcgagcgcatgacagtgcccagctccttggtcgtgatgcaaccatccccgtccttgtcgaagaggctgaaggcctccttgaactcggcgatctggtcgtcggtgagctggtccgccatgggctcggtggtggggagggagcaggtcgatcggagcgggaagcggcaggggatggatcgaggacgaggaaaaacggcttcgagcgctcgtccgctggaattttccttcccccaatttatacgcgcttccactagagcggccgtcacatttaggccgggctcggtttatcgttttagctctgactga

SEQ ID NO: 550 - protein, 171 aa, Zea mays
MTWRSSAAEMKPFWSLSNTRKASLSSSSESVSFILRAIRLRNSGKSMVPLPSASTSLIMSWSSASVGFCPSERMTVPSSLVVMQPSPSLSKRLKASLNSAIWSSVSWSAMGSVVGREQVDRSGKRQGMDRGRGKTASSARPLEFSFPQFIRASTRAAVTFRPGSVYRFSSD

SEQ ID NO: 551 - DNA, 408 bp, Zea mays
  CDS (1)..(408)
atgcacgcgtcccttcctacccttggccgcagtcaaaccctaaaccctggcgagccgcggctacggtatagccaccgcaacaccgcatctcaagcgcaagacctcctcgcggctatggcgaagcgtctgatcccgtcgctgaaccgggttctggtggagaagctgctgaagcccagcaagagcgccggcggcatcctcctcccggagaccaccaaccagctgaacgccgctaaagtcgttgctgttggccctggtgatcgtgatagggatggcaagctgatccctgtatctctgagcgaaggcgacactgttctgcttccggagtacggtgggacagaagtgaagcttgcagaaaaagagtaccttcttttcagagagcacgacatactggggaagctggaggagtga

SEQ ID NO: 552 - protein, 135 aa, Zea mays
MHASLPTLGRSQTLNPGEPRLRYSHRNTASQAQDLLAAMAKRLIPSLNRVLVEKLLKPSKSAGGILLPETTNQLNAAKVVAVGPGDRDRDGKLIPVSLSEGDTVLLPEYGGTEVKLAEKEYLLFREHDILGKLEE

SEQ ID NO: 553 - DNA, 432 bp, Zea mays
  CDS (1)..(432)
atgacgatccggttcgtgctgttcgtcaacaagcagggccagacgcggctggcgcagtactacgagcacctctccctcgacgagcgacgggccctcgagggcgagatcgtccgcaagtgcctcgcccgcactgaccagcagtgttcgtttgtggagcaccggaactacaaggtcgtttacaggcgctacgcctcccttttcttcctcgtcggcgtcgacagcgatgagaatgagttagctatccttgaattcatacatcttctggtggaaactatggatcgccacttcggcaatgtgtgcgagctcgatatcatgttccatctggagaaagtgcacttcatgttggaagagatggtgatgaatggttgcattgtggagacaagtaaacagaacatcttggcaccaatacaacttatggagaaaacttcctga

SEQ ID NO: 554 - protein, 143 aa, Zea mays
MTIRFVLFVNKQGQTRLAQYYEHLSLDERRALEGEIVRKCLARTDQQCSFVEHRNYKVVYRRYASLFFLVGVDSDENELAILEFIHLLVETMDRHFGNVCELDIMFHLEKVHFMLEEMVMNGCIVETSKQNILAPIQLMEKTS

SEQ ID NO: 555 - DNA, 378 bp, Zea mays; identical to SEQ ID NO: 335
  CDS (1)..(378)

SEQ ID NO: 556 - protein, 125 aa, Zea mays; identical to SEQ ID NO: 336

SEQ ID NO: 557 - DNA, 564 bp, Zea mays
  CDS (1)..(564)
atgatcccgatggcctcgcgccgccgcaccctgctcaaggtcatcatcctcggcgacagcggggttgggaagacgtctttgatgaaccaatatgtgaacaagaagttcagcaaccagtacaaggctacgattggggcggatttcctcaccaaggaggtgcagttcgaggacaggctcttcactctgcaaatatgggacactgctggtcaggaaaggtttcagagtcttggcgttgcattctaccggggagcagattgttgtgtcctagtctatgatgttaattctatgaaatcgtttgataatcttcacaactggcgtgaagagtttctaattcaggcgagcccatcagatcctgacaatttcccttttgttctgttgggtaacaaagttgatgtagatggtgggaacagccgtgtggtgtcggagaaaaaggcaaaggcatggtgcgcctctaaagggaacatcccgtactttgagacgtctgctaaggatggaacgaacgtggaagatgccttccagtgtattgtaaagaatgctctgaagaatgaaccggaggaagaatga

SEQ ID NO: 558 - protein, 187 aa, Zea mays
MIPMASRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLHNWREEFLIQASPSDPDNFPFVLLGNKVDVDGGNSRVVSEKKAKAWCASKGNIPYFETSAKDGTNVEDAFQCIVKNALKNEPEEE

SEQ ID NO: 559 - DNA, 1371 bp, Zea mays
  CDS (1)..(1371)
atggaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttcttcagccagactggtgctgggaagcacgttccccgtgcaatcttcgttgatctagaacccactgtgatcgatgaggtgcgcactggcacgtaccgccagctcttccaccctgagcagctcatcagtggcaaggaggatgccgctaacaatttcgcccgtggccactacacaattggcaaggagattgttgatctgtgccttgaccgtatccgcaagcttgctgacaactgcaccggcctccagggcttcctggtcttcaatgccgttggtggtggcaccggctctggccttggttctctcctccttgagcgcctgtctgtggagtacggcaagaaatccaagctgggcttcactgtgtacccatctccccaggtgtcaacctctgttgtggagccttacaacagcgtcctctccactcactcactcctggagcacactgatgtctctatcctgctcgacaacgaggccatctatgacatctgcaggcgctccctcgacattgagaggcccaactactccaacttgaatcgccttgtgtctcaggtgatctcatcgctgactgcttctctgaggttcgatggtgccctcaatgtggatgtgaacgagttccagaccaacctggttccttacccgaggatccacttcatgctctcctcctacgcaccggtgatctcttctgcgaaggccttccacgagcagctgtctgtggcggagatcaccagcagcgcgttcgagccggcttccatgatggtcaagtgcgacccacggcacggcaagtacatggcttgctgcctgatgtaccgcggcgacgtggtgcccaaggacgtgaacgccgcggtggccaccatcaagacgaagcgcaccatccagttcgtggactggtgcccgacggggttcaagtgcggcatcaactaccaggcgccgacagtggtgccgggtgccgacctcgccaaggtgcagcgtgccgtgtgcatgatctccaactccaccagcgtcgtcgaggtgttctcccgcatcaacagcaagttcgacctcatgtacgccaagcgcgcgttcgtgcactggtacgtcggcgagggcatggaggagggggagttctccgaggcacgcgaggacctggccgccctggagaaggactacgaggaggtcgccgcagagggcggcagtgatgacggtgacgaggaggaggaatactga

SEQ ID NO: 560 - protein, 456 aa, Zea mays
MEERRKMRECISVHIGQAGIQVGNACWELYCLEHGIQPDGQVPGDKTAGHHDDAFSTFFSQTGAGKHVPRAIFVDLEPTVIDEVRTGTYRQLFHPEQLISGKEDAANNFARGHYTIGKEIVDLCLDRIRKLADNCTGLQGFLVFNAVGGGTGSGLGSLLLERLSVEYGKKSKLGFTVYPSPQVSTSVVEPYNSVLSTHSLLEHTDVSILLDNEAIYDICRRSLDIERPNYSNLNRLVSQVISSLTASLRFDGALNVDVNEFQTNLVPYPRIHFMLSSYAPVISSAKAFHEQLSVAEITSSAFEPASMMVKCDPRHGKYMACCLMYRGDVVPKDVNAAVATIKTKRTIQFVDWCPTGFKCGINYQAPTVVPGADLAKVQRAVCMISNSTSVVEVFSRINSKFDLMYAKRAFVHWYVGEGMEEGEFSEAREDLAALEKDYEEVAAEGGSDDGDEEEEY

SEQ ID NO: 561 - DNA, 1347 bp, Zea mays
  CDS (1)..(1347)
atgaccatgagggagatcctgcacatccagggcggccagtgcggcaaccagatcggcgccaagttctgggaggtgatctgcgacgagcacggcatcgaccacacgggcaactacgccggcgactccgacctccagctcgagcgcatcaacgtctactacaacgaggccagcggcggccgcttcgtcccgcgcgccgtcctcatggacctcgagcccggcaccatggactccgtgcgctcgggccccttcggccagatcttccgccccgacaacttcgtcttcggccagtccggcgccggcaacaactgggccaagggccactacaccgagggcgccgagctcatcgactccgtgcttgacgtcgtgcgcaaggaggccgagaactgcgactgcctccaagggttccaagtctgccactcgctgggtggaggtactggttcaggaatgggcaccctgctcatctccaagatcagggaggagtacccggaccggatgatgttgacattctctgttttcccgtcgcccaaggtgtctgatactgttgtggagccctacaacgccacgctctccgttcaccagctcgttgagaacgcagacgagtgcatggtgctcgacaacgaggctctctatgacatctgcttccgcacgctcaagcttgccacaccaacctttggtgatctcaaccaccttatctctgcaaccatgagtggtgttacgtgctgccttcgcttccctggtcagctgaattctgacctccggaagcttgcagtgaacctgatccccttcccacgtctgcacttcttcatggttggatttgctccactgacctcgcggggctcccagcagtaccgcgctctcaccgtgccagagctgacccagcagatgtgggactccaagaacatgatgtgtgctgctgaccctcgccacggccgctacctcacggcatctgctatgttccgtgggaagatgagcaccaaggaagtggatgagcaaatgctgaacgtgcagaacaagaactcttcctactttgtggagtggatccctaacaatgtgaagtcgagtgtgtgtgacatcccacccatcggcctgaagatgtcctccacattcatcggcaactcgacctccatccaggagatgttccgccgcgtcagcgagcagttcactgccatgttcaggaggaaggccttcttgcattggtacacgggtgagggcatggatgagatggagttcactgaggcagagagtaacatgaatgacctggtggccgagtaccagcagtaccaagacgccacagctgaggatgaggaggagtacgaggaggaagaagaggaagatcctgctgcctga

SEQ ID NO: 562 - protein, 448 aa, Zea mays
MTMREILHIQGGQCGNQIGAKFWEVICDEHGIDHTGNYAGDSDLQLERINVYYNEASGGRFVPRAVLMDLEPGTMDSVRSGPFGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPTFGDLNHLISATMSGVTCCLRFPGQLNSDLRKLAVNLIPFPRLHFFMVGFAPLTSRGSQQYRALTVPELTQQMWDSKNMMCAADPRHGRYLTASAMFRGKMSTKEVDEQMLNVQNKNSSYFVEWIPNNVKSSVCDIPPIGLKMSSTFIGNSTSIQEMFRRVSEQFTAMFRRKAFLHWYTGEGMDEMEFTEAESNMNDLVAEYQQYQDATAEDEEEYEEEEEEDPAA

SEQ ID NO: 563 - DNA, 819 bp, Zea mays
  CDS (1)..(819)
atgcacgaggccgacaactctctaccgtccgagaccccaagcaccagcgcggcggcggcggcggcggcggcggcgaccatggctgtcgggaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttggggtatgaattttaccactgataaattgagatccctagtgaagaagtggcagacattaatcgaagcccatgttgatgtcaagacaaccgacaactacatgttgcgtttgttctgcatcggcttcaccaagaggcgcccaaaccaggtcaagagaacctgctatgctcaggcatcccagatccgtcagatccgccgtaagatggttgagattatgatcaaccaggcttctacatgtgacctgaaagaacttgtttcgaagttcattccagaagttattggtaaggagattgagaagtctacctccagcatcttcccacttcaaaacgtcttcatccgcaaggtgaagatactcaaggcccccaagttcgatcttgggaagctcatggaggttcacggcgactacaaagaggatgttggtgtgaagcttgagaggccttga

SEQ ID NO: 564 - protein, 272 aa, Zea mays
MHEADNSLPSETPSTSAAAAAAAAATMAVGKNKRISKGKKGGKKKTVDPFSKKDWYDIKAPSVFSVRNIGKTLVSRTQGTRIASEGLKHRVFEVCLADLQGDEDQAYRKIRLRAEDVQGRNVLTNFWGMNFTTDKLRSLVKKWQTLIEAHVDVKTTDNYMLRLFCIGFTKRRPNQVKRTCYAQASQIRQIRRKMVEIMINQASTCDLKELVSKFIPEVIGKEIEKSTSSIFPLQNVFIRKVKILKAPKFDLGKLMEVHGDYKEDVGVKLERP

SEQ ID NO: 565 - DNA, 558 bp, Zea mays
  CDS (1)..(558)
atgcaccggcgcctcccttccgctcccctgcctgctaatccctccggccaccccgaaaccgctcgctcgctcgctcgctccccgcgcccagagacaagcccggagaccatggcggaccagctcactgacgaccaaatcgccgagttcaaggaggccttcagcctcttcgataaggacggcgacggttgcatcacaaccaaggagcttggaactgttttgcgttcactgggtcagaacccaacggaggctgaactccaggacatgatcaatgaggtggatgccgacggcaatggcacgatcgacttccccgagttcctcaacctcatggcccgcaagatgaaggacaccgactccgaggaggagctcaaggaggcgttcagggtgttcgacaaggaccagaacggcttcatctctgccgcggagctccgccacgtgatgaccaacctaggcgagaagctgaccgacgaggaggtcgacgagatgatccgcgaggccgacgttgatggcgatggccagatcaactacgaggagttcgtcaaggtcatgatggccaagtga

SEQ ID NO: 566 - protein, 185 aa, Zea mays
MHRRLPSAPLPANPSGHPETARSLARSPRPETSPETMADQLTDDQIAEFKEAFSLFDKDGDGCITTKELGTVLRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 567 - DNA, 621 bp, Zea mays
  CDS (1)..(621): n means a or g or c or t/u
atggccangcgccgccgcaccctgctcaaggtcatcatcctcggcgatagtggggttgggaagacttccttgatgaaccaatatgtgaacaagaagttcagcaatcagtacaaggctacgatcggcgcggatttcctcaccaaggaggtgcagttcgaggacaggctcttcactctgcaaatatgggacactgctggccaggaaaggtttcagagtctcggcgttgcattctaccggggagcagattgttgtgtcctagtctatgatgttaattctatgaaatcatttgacaacctgaataactggcgagaagagtttctaattcaggctagcccatcagatcctgataatttcccttttgttctgttgggtaacaaagttgatgtagatggtggcaacagccgcgtggtatctgagaaaaaggcaaaggcatggtgtgcttccaaagggaacatcccgtactttgagacgtctgctaaggacggaacgaacgtggaagacgccttccagtgtatcgtgaagaatgctctgaagaatgagccagaggaagaactgtatgtgccagataccgtggacgtggtgggtggcaaccgggcccnagagatcatccgggtgctgtga

SEQ ID NO: 568 - protein, 206 aa, Zea mays
  misc_feature (3)..(3): Xaa can be Lys or Thr or Arg or Met
  misc_feature (200)..(200): Xaa can be Arg or Gln or Leu or Pro
MAXRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPDNFPFVLLGNKVDVDGGNSRVVSEKKAKAWCASKGNIPYFETSAKDGTNVEDAFQCIVKNALKNEPEEELYVPDTVDVVGGNRAXEIIRVL

SEQ ID NO: 569 - DNA, 471 bp, Zea mays
  CDS (1)..(471): n means a or g or c or t/u
atggccaagcnccgccttctcaagttctacagtttccagccacccgagaagcatcaggacctcgtccgctgtgtcttccaattactctctgcaaggcccgagagcgcgagcaattttgtcaaggtggactccatctttggcccgggaacaaaaatggtctacaagcatttggccacactatactttgtttttgtctttgatagctctgagaacgagcttgccatgctcgacctcgtacaagtgtttgttgaaacattggacagatgcttcaagaatgtatgcgagcttgacatcgtatttaacttcaacaagctgcacaccattttggatgagatgatatcggggggacaggtgatcgaaacaagttcagaacagataatgaaatctgtggaagagattgaaaggctggagaaacaatcgagcacaaccagcttcatacccaagtcgattacagagcgttttacccgttga

SEQ ID NO: 570 - protein, 156 aa, Zea mays
  misc_feature (4)..(4): Xaa can be His or Pro or Arg or Leu
MAKXRLLKFYSFQPPEKHQDLVRCVFQLLSARPESASNFVKVDSIFGPGTKMVYKHLATLYFVFVFDSSENELAMLDLVQVFVETLDRCFKNVCELDIVFNFNKLHTILDEMISGGQVIETSSEQIMKSVEEIERLEKQSSTTSFIPKSITERFTR

SEQ ID NO: 571 - DNA, 492 bp, Zea mays
  CDS (1)..(492)
atgtctagggagttttacacagggaacgaacagtcactcccacatagcatctgcaagttcagcacttgcaaagcatcattatttttaagcacgggaatggtaacacacatgtcaagcagtgatggttgtcttcgaggcagaaccggcgatggctccagcctcagtcagcagaggcaccagcttcccatcattgttcagtgccatagtatcatcacagccgccaatatgcttcccattgatgaagacatttgggacagtcctctgtccagtccactccttcagggcattctggagctcagctccatcactttccttatccaactcaatggccttgtagcttgctccgagcttctcgaacaactgcttcacacggacgcagaaaggacaggaagttttgctgaagacgacgaggggagcggaggcaacgatctccttggccttggcgagcgccattgctctcgattccgggctggaggttgggctggaggttga

SEQ ID NO: 572 - protein, 163 aa, Zea mays
MSREFYTGNEQSLPHSICKFSTCKASLFLSTGMVTHMSSSDGCLRGRTGDGSSLSQQRHQLPIIVQCHSIITAANMLPIDEDIWDSPLSSPLLQGILELSSITFLIQLNGLVACSELLEQLLHTDAERTGSFAEDDEGSGGNDLLGLGERHCSRFRAGGWAGG

SEQ ID NO: 573 - DNA, 840 bp, Zea mays
  CDS (1)..(840)
atggccagacactccgtagtctgtaccccaagcaccggcgcggcggcggcggctaccatggcagtcgggaagaacaagaggatctccaagggaaagaagggtggtaagaaaaagaccgtcgatcccttctctaagaaggactggtatgacatcaaggccccatcggtcttcagtgtgcgcaacattgggaagactctcgtgtccaggacacagggtaccaggattgcctctgatggtctgaagcacagagtctttgaggtttgtctagctgatcttcagggtgacgaggatcaggcttacaggaaaatcaggctccgtgctgaagatgtgcaaggcaggaatgtgctcacaaacttctggggcatgaattttaccaccgataagctcagatctctagtaaagaagtggcagacattgattgaagcccatgttgatgtcaagacaaccgacaactacatgctgcgtttgttctgcattggttttaccaagaggcgcccaaaccaggtcaagagaacctgctatgctcaggcatcccagattcggcagattcgccgcaagatggttgagattatgatcaaccaggcttctacatgtgaccttaaagaacttgtttctaagttcattccggaagttattggcaaagagattgagaagtctacctccagcatcttcccacttcaaaacgtcttcatccgcaaggtgaagatactcaaggcccccaagtttgatctcgggaagttgatggaggttcatggcgactacaaagaggacgttggtgtgaagcttgagaggcctgtcgagggtgatgaggctatgcaggaggttgctgctgccgagtga

SEQ ID NO: 574 - protein, 279 aa, Zea mays
MARHSVVCTPSTGAAAAATMAVGKNKRISKGKKGGKKKTVDPFSKKDWYDIKAPSVFSVRNIGKTLVSRTQGTRIASDGLKHRVFEVCLADLQGDEDQAYRKIRLRAEDVQGRNVLTNFWGMNFTTDKLRSLVKKWQTLIEAHVDVKTTDNYMLRLFCIGFTKRRPNQVKRTCYAQASQIRQIRRKMVEIMINQASTCDLKELVSKFIPEVIGKEIEKSTSSIFPLQNVFIRKVKILKAPKFDLGKLMEVHGDYKEDVGVKLERPVEGDEAMQEVAAAE

SEQ ID NO: 575 - DNA, 1407 bp, Zea mays
  CDS (1)..(1407)
atgtctcctcgctctccctattctggacggccgactcgcttctgtgagctaccggccttagatccagccatgagggagattctccacatccagggcggccagtgcggtaaccagatcggttccaagttctgggaggtcgtctgcgacgagcatggtatcgatcccaccggacgctatgtcggcacctccgacctccagctcgagcgcgtcaatgtctactacaacgaggcctcatgcggccgcttcgtgccgcgcgctgtgctcatggacctcgagcctggcaccatggacagcgtccgcaccggaccgtacggccagatcttccgccccgacaactttgtcttcggacagtctggcgcggggaacaactgggccaagggccactacacagagggcgcagagctcattgactccgtgcttgacgttgtcagaaaggaggctgagaactgcgactgcctccaaggcttccaagtctgccattcccttggaggaggcactggatctggaatgggcacgcttctcatttcaaagatcagagaggagtaccctgatcggatgatgctgacattttctgtctttccctcgcccaaggtgtcagacactgttgttgagccatacaatgcaaccctgtctgtccatcagttggttgagaacgctgatgaatgcatggttcttgacaacgaagcactttatgacatttgcttccgaactctgaagctgacgacccctagctttggagacttgaaccacttgatcagtgcaacgatgagtggtgtcacttgctgcctccgcttcccaggacagcttaactctgacctgcgcaagcttgcagtcaacctgatcccgttccctcggctccacttcttcatggttggctttgcgccactcacctcgcgtggctcgcagcagtaccgtgctctcactgtccctgagctaacccagcagatgtgggatgccaagaacatgatgtgtgctgctgacccacgccatggtcgttatctcacagcctctgccatgttccgtggcaagatgagcactaaggaggttgatgagcaaatgattaatgtccagaacaagaactcgtcctactttgtggagtggatccccaacaacgtcaagtccagtgtttgtgatatccctccgcgtggcctctccatggcctccaccttcattggcaactccacgtccatccaggagatgttccgccgtgtgagcgagcagttcactgctatgttcaggaggaaggctttcttgcattggtacactggtgagggcatggatgagatggagttcaccgaagctgagagcaacatgaacgatctggtgtccgagtaccagcagtaccaggatgccactgctgatgaggaggcggaatacgaggacgaggaggccatccaagacgagtga

SEQ ID NO: 576 - protein, 468 aa, Zea mays
MSPRSPYSGRPTRFCELPALDPAMREILHIQGGQCGNQIGSKFWEVVCDEHGIDPTGRYVGTSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPRGLSMASTFIGNSTSIQEMFRRVSEQFTAMFRRKAFLHWYTGEGMDEMEFTEAESNMNDLVSEYQQYQDATADEEAEYEDEEAIQDE

SEQ ID NO: 577 - DNA, 666 bp, Zea mays
  CDS (1)..(666)
atgagcaaggtgttcgagggctacgagcgccagtactgcgaggcgtccgcctccctcacccgcaaatgcaccgccgccgccgccctacagggagagaagctgaagcagaaggcggcggagatccaatccggcatcgatggcgctgaggcactgataaggaagatggatcttgaagcaagaaacctgcaaccaagcattagagctgatctcctagtaaagatcagggagtacaagtcagatcttaataaccttaagggagcgctgaagagggttactagtattaatgcacaacagggggcgagggaggagttgttggagtcaggaatggcagatacattgggggtttctgctgatcaaaggtcaagattgctcagggcaaccgagagacagaaccaaacaactgataggctcagagatagccatagaactatgctggagactgaagaacttggtgtctctatcctgcatgacctgagtcaacagcgccagtctctcttgcatgctcatgatgtattggacgaagtggataacaacgtcggcaagagcaggaggaccattggaggcatgatgaggagaatggatagaaacaagtggatcatcggtctcatcatagcagttcttgtcttggctatcctcgtgattctgtatttcaagttcgtgcactga

SEQ ID NO: 578 - protein, 221 aa, Zea mays
MSKVFEGYERQYCEASASLTRKCTAAAALQGEKLKQKAAEIQSGIDGAEALIRKMDLEARNLQPSIRADLLVKIREYKSDLNNLKGALKRVTSINAQQGAREELLESGMADTLGVSADQRSRLLRATERQNQTTDRLRDSHRTMLETEELGVSILHDLSQQRQSLLHAHDVLDEVDNNVGKSRRTIGGMMRRMDRNKWIIGLIIAVLVLAILVILYFKFVH

SEQ ID NO: 579 - DNA, 318 bp, Zea mays
  CDS (1)..(318)
atggcggacgagaatgaggctgggaagaaagaggaagaggaatttagcacaggccctctgtcagtactaatgatgagtgttaagaacaacacccaggttctcatcaattgccgcaacaacaagaagctgcttggccgggttcgtgcttttgatcgccactgtaacatggtgctcgagaacgtgcgggagatgtggacagaggtccccaagactggcaagggcaaaaagaaggctctgcctgtgaacaaggatagattcatcagcaagatgttcctcaggggcgactcggtcatcatcgtgctgaggaaccccaagtga

SEQ ID NO: 580 - protein, 105 aa, Zea mays
MADENEAGKKEEEEFSTGPLSVLMMSVKNNTQVLINCRNNKKLLGRVRAFDRHCNMVLENVREMWTEVPKTGKGKKKALPVNKDRFISKMFLRGDSVIIVLRNPK

SEQ ID NO: 581 - DNA, 693 bp, Zea mays
  CDS (1)..(693)
atgtctcctcgcctgctcatccgccgctgcttcccttctctgggctcggagaaccggagagaagcgcgcgcggccatggcgtccagcgcctctcggttcatcaagtgcgtcacggtcggcgacggtgccgtgggcaagacatgtatgctcatctgctacaccagcaacaagttccccactgactacatacctacggtgttcgacaatttcagtgcaaatgtagttgtggatggcaccactgtgaatttgggcctttgggataccgctgggcaggaagattacaaccgcctgaggcctctaagctaccgaggtgcagatgttttcgtgcttgcattctcacttgtgagccgagctagctatgagaatatcatgaagaagtggataccagagcttcaacattatgcacctgaggtgcccgttgttttggcaggcacaaaattggatcttcgtgaagacaagcactacttgatggaccatcctggattggtgcctgttaccactgcacagggggaggaacttcgtagacaaattggtgctatgtattacattgaatgcagctcaaagacacagcagaatgtcaaagctgtgttcgatgctgccatcaaggtagtaatccagcctccaactaaaataagagaaaagaagaagaaaaaatcacgcaaaggatgttctatgatgaacatcttcggttga

SEQ ID NO: 582 - protein, 230 aa, Zea mays
MSPRLLIRRCFPSLGSENRREARAAMASSASRFIKCVTVGDGAVGKTCMLICYTSNKFPTDYIPTVFDNFSANVVVDGTTVNLGLWDTAGQEDYNRLRPLSYRGADVFVLAFSLVSRASYENIMKKWIPELQHYAPEVPVVLAGTKLDLREDKHYLMDHPGLVPVTTAQGEELRRQIGAMYYIECSSKTQQNVKAVFDAAIKVVIQPPTKIREKKKKKSRKGCSMMNIFG

SEQ ID NO: 583 - DNA, 501 bp, Zea mays
  CDS (1)..(501)
atgcggtttgcctctctgccttccctacctcagatcctccctcagattgccatggcggaccagctcaccgacgaccagatcgccgagttcaaggaagcattcagcctcttcgacaaggacggcgacggctgcatcaccaccaaggaacttggttctgtgatgcgctcgttggggcagaaccctactgaggctgagcttcaggacatgatcaacgaggttgatgctgatggcaatggaaccatcgacttccctgagtttctcaacctgatggcacgcaagatgaaggacaccgactctgaggaggagctcaaagaggccttccgcgtgttcgacaaggaccagaacggcttcatctctgctgctgagcttcgacatgtcatgaccaacctaggtgagaagctgacggacgaggaggtggatgagatgattcgtgaagccgacgtggacggtgatggccagatcaactacgaggagttcgtgaaggtgatgatggccaagtga

SEQ ID NO: 584 - protein, 166 aa, Zea mays
MRFASLPSLPQILPQIAMADQLTDDQIAEFKEAFSLFDKDGDGCITTKELGSVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 585 - DNA, 882 bp, Zea mays
  CDS (1)..(882): n means a or g or c or t/u
atgnttcccgggtcgacttcgctgtcgacgatttcgtgcgacgaagcatcaccagtaaggatgacgggctcaatggatancccggccaagggcgggttcagcttcgacctgtgccgccgcaacagcatgctggagaagaacgggctcaaactcccgggattcaggaagaccggaacaaccatcgtcggcctcgtctttcaggatggggttgttcttggggcagacacaagagcaactgaggggcctatagttgctgataagaattgtgagaagatccactttatggcgccaaacatttattgttgtggagcaggaactgctgctgacactgaggctgttacagacatggtcagctcacagctacagctgcaccgttatgcaacgggtcgcgaatctagagtcgtaactgctcttacactgctgaagtcacatctctttaggtatcaaggccatgtcagtgctgcccttgttcttggtggagtggattgtactggaccacatcttcacactgtttatccacacggctccactgatactcttccttttgccacgatgggttctggatcccttgctgcaatgtcagtgtttgaatcgaagtataaagaaggcctcactagggaagagggaatacaactggtgtcagaagcaatatgtgcaggtatcttcaatgacttgggtagtggaagcaatgtggatgtctgcgtgataaccaaggggaagacagaatacttgagaaatcaccagttgccgaatcccagaacttatgttagttcaaagggatatagcttcaccaaggggcagactgaggtgctgtccgcaaagatcacacatctcaagcagaaggttgaggtcactgagggcggtgatgctatggaggagtga

SEQ ID NO: 586 - protein, 293 aa, Zea mays
  misc_feature (2)..(2): Xaa can be Ile or Leu or Val or Phe
  misc_feature (27)..(27): Xaa can be Asn or Thr or Ser or Ile
MXPGSTSLSTISCDEASPVRMTGSMDXPAKGGFSFDLCRRNSMLEKNGLKLPGFRKTGTTIVGLVFQDGVVLGADTRATEGPIVADKNCEKIHFMAPNIYCCGAGTAADTEAVTDMVSSQLQLHRYATGRESRVVTALTLLKSHLFRYQGHVSAALVLGGVDCTGPHLHTVYPHGSTDTLPFATMGSGSLAAMSVFESKYKEGLTREEGIQLVSEAICAGIFNDLGSGSNVDVCVITKGKTEYLRNHQLPNPRTYVSSKGYSFTKGQTEVLSAKITHLKQKVEVTEGGDAMEE

SEQ ID NO: 587 - DNA, 723 bp, Zea mays
  CDS (1)..(723): n means a or g or c or t/u
atggccangcgccgccgcaccctgctcaaggtcatcatcctcggcgatagtggggttgggaagacttccttgatgaaccaatatgtgaacaagaagttcagcaatcagtacaaggctacgatcggcgcggatttcctcaccaaggaggtgcagttcgaggacaggctcttcactctgcaaatatgggacactgctggccaggaaaggtttcagagtctcggcgttgcattctaccggggagcagattgttgtgtcctagtctatgatgttaattctatgaaatcatttgacaacctgaataactggcgagaagagtttctaattcaggctagcccatcagatcctgataatttcccttttgttctgttgggtaacaaagttgatgtagatggtggcaacagccgcgtggtatctgagaaaaaggcaaaggcatggtgtgcttccaaagggaacatcccgtactttgagacgtctgctaaggacggaacgaacgtggaagacgccttccagtgtatcgtgaagaatgctctgaagaatgagccagaggaagaactgtatgtgccagataccgtggacgtggtgggtggcaaccgggcccnagagatcatccgggtgctgttaaggcacgaggcatcacgaggcgttgtgaccatcatcgtcggttatgcagtgaccaaacaataccttagcattgctgnggtctccgtggttatctacgtatga

SEQ ID NO: 588 - protein, 240 aa, Zea mays
  misc_feature (3)..(3): Xaa can be Lys or Thr or Arg or Met
  misc_feature (200)..(200): Xaa can be Arg or Gln or Leu or Pro
  misc_feature (233)..(233): Xaa can be Ala or Glu or Gly or Val
MAXRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLNNWREEFLIQASPSDPDNFPFVLLGNKVDVDGGNSRVVSEKKAKAWCASKGNIPYFETSAKDGTNVEDAFQCIVKNALKNEPEEELYVPDTVDVVGGNRAXEIIRVLLRHEASRGVVTIIVGYAVTKQYLSIAXVSVVIYV

SEQ ID NO: 589 - DNA, 612 bp, Zea mays; identical to SEQ ID NO: 263
  CDS (1)..(612)

SEQ ID NO: 590 - protein, 203 aa, Zea mays; identical to SEQ ID NO: 264

SEQ ID NO: 591 - DNA, 420 bp, Zea mays
  CDS (1)..(420)
atgacctccgagtcctcaactcctactggatcaaccagggctctacctgcgagtattacgaggtcatcctcgtcgaccctcagcacaaggccatccgcatcgacccccgcatcaactggatcgttaaccccgtccacaagcaccgcgagtctcgtggtctcaccgccaccggcaagaagtcccgtggtctcaacaagggccaccgctacaacaagacccaggctggccgcagaaagacctggaagcgccacaacaccctgtccctgtggcgataccgataaacagctcgccccctgcttacaggaaggagctggctttgttattcgcaacgcggctgttcggttgtacatgcgatttgggagggtctggttttggcactgcatgcttggactctggggagtcgggaaccttatttggtga

SEQ ID NO: 592 - protein, 139 aa, Zea mays
MTSESSTPTGSTRALPASITRSSSSTLSTRPSASTPASTGSLTPSTSTASLVVSPPPARSPVVSTRATATTRPRLAAERPGSATTPCPCGDTDKQLAPCLQEGAGFVIRNAAVRLYMRFGRVWFWHCMLGLWGVGNLIW

SEQ ID NO: 593 - DNA, 522 bp, Zea mays
  CDS (1)..(522)
atggggttcgtcggagacacgatggagtcgatccgctccatgcagatccgccaagtgctcatgcagatcatcagcctcggtatgattgttacctctgcattaatcatatggaagggtttgatagttttcacggggagcgagtcaccagttgtagtggtgctctcgggtagcatggagcctggatttaaaaggggtgatatcctgtttttgcatatgagcaaagatcctattcgcacaggagaaatagttgttttcaatgtcgatggtcgtgagattccaattgtccaccgagtgattaaggtccatgaacgtcaggacactgcagaagtggacatcctcaccaaaggtgacaataattttggggatgaccgactattatatgcacatggccagctttggctccagcaacaccacattatggggcgtgcggtgggctaccttccatatgttggctgggttacaattatcatgactgagaaaccatttattaagtacctgctgattggcgcactgggcttgtga

SEQ ID NO: 594 - protein, 173 aa, Zea mays
MGFVGDTMESIRSMQIRQVLMQIISLGMIVTSALIIWKGLIVFTGSESPVVVVLSGSMEPGFKRGDILFLHMSKDPIRTGEIVVFNVDGREIPIVHRVIKVHERQDTAEVDILTKGDNNFGDDRLLYAHGQLWLQQHHIMGRAVGYLPYVGWVTIIMTEKPFIKYLLIGALGL

SEQ ID NO: 595 - DNA, 1557 bp, Zea mays
  CDS (1)..(1557)
atggccgccatcacgccgccgacgcagtcggagccgtcgccgcagacggggcgcccggcctcgtctgccgccgccgcggccaagcgtggagggggcggggctggtgccgccggcgggccgctgatggggaagtacgagctggggcgcctcctggggcacggcaccttcgcgaaggtgtaccacgcgcggcacgtcgacacgggggacaacgttgccatcaaggtgctcgacaaggagaaggccgtgaagagcgggctcgtcccgcacatcaagcgcgagatcgctgtgctacgccgcgtgcgccacccgaacatcgtgcacctgttcgaggttatggccacaaagactaagatctacttcgtcatggagctcgtccgcggcggcgagctcttctcccgcgtctccaagggccgactcagggaggacaccgcgcgccgctacttccagcagctcgtctccgccgtggggttctgccacgcccgcggcgtcttccaccgcgacctgaagcccgagaatctactcgtcgacgagcaggggaacctcaaggtatcggattttgggctctccgccgtcgccgagcagttccgtcccgacggcctgctccacaccttctgcggcaccgcggcctatgtggcccccgaagtgctcggccgccgcgggtacgacggcgccaaggcagacgtgtggtcgtgcggtgtcatcctctttgtgctcatggccggatatctccctttccatgacaaaaacatcatggccatgtacaagaagatttacaagggcgagttccgctgtgcgaggtggttctccaaagaccttaccagcttgctgatgcgcattcttcacactaatcccaacactcggatcactttgccggagatcatggagtcccgctggttcaagaaaggattcaagcctgtcaagttctatatcgaggatgaccagctgcataacgttatagatgacgaagatggcctgttagatatgggacctgctggtcctgttcctccaccattgccacctccaccgccacctctacctccaccaaaggttgatggtgatgaatcagggtctgactcagactcgtcgatctcatcctgccctgcttcaatgttatctgatgagagccaaaggccccgtggctctctaccacgtccagcaagtcttaatgcctttgatatcatatcattttcaaggggatttaacttatcagggttatttgaggagaaaggggatgaagtgaggttcatctcggctgagcccatgtcagatatcataaccaaattggaggacatagcgaagctgaagagcttcaagttgcggaggaaggactggcgcatctgcctggagggtacaagggaaggagttaaggggccattaacaattggcgcggagatatttgaactcacacctccccttgtaatggtggaggtaaaaaagaaggcaggggataatgaagagtacgagaacttctgtgacaaggaattgaagccagggatgcagcaccttgtccaccatatggtccgagctccaagtatgctgcttactgatgccaagtga

SEQ ID NO: 596 - protein, 518 aa, Zea mays
MAAITPPTQSEPSPQTGRPASSAAAAAKRGGGGAGAAGGPLMGKYELGRLLGHGTFAKVYHARHVDTGDNVAIKVLDKEKAVKSGLVPHIKREIAVLRRVRHPNIVHLFEVMATKTKIYFVMELVRGGELFSRVSKGRLREDTARRYFQQLVSAVGFCHARGVFHRDLKPENLLVDEQGNLKVSDFGLSAVAEQFRPDGLLHTFCGTAAYVAPEVLGRRGYDGAKADVWSCGVILFVLMAGYLPFHDKNIMAMYKKIYKGEFRCARWFSKDLTSLLMRILHTNPNTRITLPEIMESRWFKKGFKPVKFYIEDDQLHNVIDDEDGLLDMGPAGPVPPPLPPPPPPLPPPKVDGDESGSDSDSSISSCPASMLSDESQRPRGSLPRPASLNAFDIISFSRGFNLSGLFEEKGDEVRFISAEPMSDIITKLEDIAKLKSFKLRRKDWRICLEGTREGVKGPLTIGAEIFELTPPLVMVEVKKKAGDNEEYENFCDKELKPGMQHLVHHMVRAPSMLLTDAK

SEQ ID NO: 597 - DNA, 543 bp, Zea mays
  CDS (1)..(543)
atggggttcgtcggagacacgatggagtcgatccgctccatgcagatccgccaagtgctcatgcagatcatcagcctcggtatgattgttacctctgcattaatcatatggaagggtttgatagttttcacggggagcgagtcaccagttgtagtggtgctctcgggtagcatggagcctggatttaaaaggggtgatatcctgtttttgcatatgagcaaagatcctattcgcacaggagaaatagttgttttcaatatcgatggtcgtgagattccaattgtccaccgagtgattaaggtccatgaacgtcaggacactgcagaagtggacatcctcaccaaaggtgacaataattttggggatgaccgactattatatgcacatggccagctttggctccagcaacaccacattatgggacgtgcggtgggctaccttccatatgttggctgggttacaattatcatgactgagaaaccatttattaagtacctgctgattggcgcactgggcttgctggtcataacgtcgaaagattga

SEQ ID NO: 598 - protein, 180 aa, Zea mays
MGFVGDTMESIRSMQIRQVLMQIISLGMIVTSALIIWKGLIVFTGSESPVVVVLSGSMEPGFKRGDILFLHMSKDPIRTGEIVVFNIDGREIPIVHRVIKVHERQDTAEVDILTKGDNNFGDDRLLYAHGQLWLQQHHIMGRAVGYLPYVGWVTIIMTEKPFIKYLLIGALGLLVITSKD

SEQ ID NO: 599 - DNA, 927 bp, Zea mays
  CDS (1)..(927)
atgcacgagctcaaacagaccctaacacgcccctttcttgcgagtgaggccaaagccgagcaaacaaaacgatatgccgctgccctgaaccgagaccaccaccgctctgcctcgcctcgcctcgcctcgcgtcgtctcacctcacctcgccgactagggttttgtaccgccgtggatctcgccgtccccgccatggacgtctcgcacgcgggatcctccgtcgccggcgaggctccgaccaccggggagcaccggatggggactaccatcgtcggggtctgctacgagggcggcgtcgtcctgggcgccgattccaggaccagcactggaatgtatgtagccaaccgtgcttcagacaagattactcaactgacagacaatgtgtatgtctgtcgctctggatctgctgctgatacacaagtcatttcggattatgtacgctatttcctccaccaacacacaatccagcttggacaaccagctaccgttaaagttgcagccaacttgattaggttgctagcttatcagaacaagaacatgttgcaagctggcatgattgttggaggatgggacaagtacgagggaggccaaattttctcagtccctctcggtggaacgatcttgaagcaaccatttgcaattggaggttcaggttccagttacctatatgctcttcttgatcatgaatggaaagagggaatgagtcaggaagaggcagagaaatttgtggtgaaggtagtttcccttgctatggcccgtgatggtgctagtggaggggttgtccgtacagttacaataaatgcggatggcgtgaagaggaacttttaccctggcgacaagctacccctgtggcacgacgagctggaaccccagaactcgttgcttgatattcttgctgctgggaaccctgatcccatggtgcagtga

SEQ ID NO: 600 - protein, 308 aa, Zea mays
MHELKQTLTRPFLASEAKAEQTKRYAAALNRDHHRSASPRLASRRLTSPRRLGFCTAVDLAVPAMDVSHAGSSVAGEAPTTGEHRMGTTIVGVCYEGGVVLGADSRTSTGMYVANRASDKITQLTDNVYVCRSGSAADTQVISDYVRYFLHQHTIQLGQPATVKVAANLIRLLAYQNKNMLQAGMIVGGWDKYEGGQIFSVPLGGTILKQPFAIGGSGSSYLYALLDHEWKEGMSQEEAEKFVVKVVSLAMARDGASGGVVRTVTINADGVKRNFYPGDKLPLWHDELEPQNSLLDILAAGNPDPMVQ

SEQ ID NO: 601 - DNA, 717 bp, Zea mays
  CDS (1)..(717)
atgttcgatcaggtcatcatcgtcatcggggaggggctgcgcagcggcagctgcaagctcagcttcatgctgctgctgcagggccatatcaatctgcacttctggtggcttcagagcaacagcttcaacaaagtgaaggttctgatcccctgccagcttcctagcgaggtaaaggaagggcttctcaaagttgtaattgctcttggcagaaatctcatagtactgcaagttcttcttccggtggaatgtaacttgcttggccttgacttgcctgttcttgacatcaaccttgttaccacaaagaacaatggggatgttctcacagaccctgcacaggtccctgtgccatgtcggaacattcttgtatgtcagcctagaagtgacatcaaacataatgatggcacactgaccatgaatgtagtagccatccctaaggccaccgaacttttcttgcccagcagtgtcccagcaataaaagcgaattttgccacagttagtgctaaaatccagagggtgaacttcaacaccaatggtgggctcatatttcttctcaaactcgccagtaagatgccttttcacaaatgtggttttaccagttccaccgtcgccaacgatgacgagcttgaagctggggtaatccacgccctgctgattcggcagcgccatttctacggcgcgaagaggagtacggtacggggcagcggtgaacagagatga

SEQ ID NO: 602 - protein, 238 aa, Zea mays
MFDQVIIVIGEGLRSGSCKLSFMLLLQGHINLHFWWLQSNSFNKVKVLIPCQLPSEVKEGLLKVVIALGRNLIVLQVLLPVECNLLGLDLPVLDINLVTTKNNGDVLTDPAQVPVPCRNILVCQPRSDIKHNDGTLTMNVVAIPKATELFLPSSVPAIKANFATVSAKIQRVNFNTNGGLIFLLKLASKMPFHKCGFTSSTVANDDELEAGVIHALLIRQRHFYGAKRSTVRGSGEQR

SEQ ID NO: 603 - DNA, 681 bp, Zea mays
  CDS (1)..(681)
atggctccgcgcactccaccccactcgccgccgccgctgccaacgccgcttgctgccgcagccgccatgggggcgtacaagtacgtgtcggaactatggaggaggaagcagtcggacgtgatgcgcttcgtgcagcgcgtgcgctgctgggagtacaggcagcagccgtccatcgtccgcctcaccaggcccacccgccccgacaaggcccgtcgtctcggctacaaggccaagcagggatatgttgtctaccgtgtccgtgtgaagcgtggtggcaggaagaggcctgtgcccaagggtattgtctatggcaagcccaagcaccagggtatcacccagctcaagttccagaggaacaagaggtctgtcgctgaggagagagctggacgtaagcttggtggactgagggttcttaactcctactgggtgaatgaggatagtacctacaagtactttgagatcatccttgtggacgttgcccacaaagccatcaaaaccgacccgaggatcaactggctatgcaaccctgtgcacaagcaccgtgagctccgtggcctcacctcagcaggcaagaagtaccgtggcctgcgtggcaagggccacacccaccacaagaacaggccctcaaggagagccacctggaagcgcaaccagaccctctccctccgccgctaccgctga

SEQ ID NO: 604 - protein, 226 aa, Zea mays
MAPRTPPHSPPPLPTPLAAAAAMGAYKYVSELWRRKQSDVMRFVQRVRCWEYRQQPSIVRLTRPTRPDKARRLGYKAKQGYVVYRVRVKRGGRKRPVPKGIVYGKPKHQGITQLKFQRNKRSVAEERAGRKLGGLRVLNSYWVNEDSTYKYFEIILVDVAHKAIKTDPRINWLCNPVHKHRELRGLTSAGKKYRGLRGKGHTHHKNRPSRRATWKRNQTLSLRRYR

SEQ ID NO: 605 - DNA, 678 bp, Zea mays
  CDS (1)..(678)
atgtcgcgcgcttcactttccccaccccgccgccgccatcgcacgcccgcagccgcatccgctatgggtgcgtacaagtacgtctcggagctatggcggaggaagcagtccgatgtgatgcggttcgtgcagcgcgtgcgctgctgggagtacaggcagcagccggccatcgtccgcctcacaaggcccactcgccctgacaaggcgcgccgcctcggctacaaggccaagcagggttatgttgtttaccgtgtccgtgttaggcgtggtggcaggaagaggcctgtgcctaaaggtattgtctatggcaagccaaagcaccagggtatcacccagctcaagttccagaggaacaagaggtctgttgctgaggagagggctggacgaaagcttggtggactcagggttctcaactcctactgggtgaatgaggatagcacctacaagtactttgagatcattcttgttgatgtggcccacactaccatccgcaatgatccaaggatcaactggctatgcaatcctgtgcacaagcaccgggagctccgtggtctcacctccgcaggcaagaagttccgtggcctgcgtggcaagggccacactcaccacaagaataggccgtcgaggagggccacctggaagcgcaaccagaccctttccctccgccgctaccgttga

SEQ ID NO: 606 - protein, 225 aa, Zea mays
MSRASLSPPRRRHRTPAAASAMGAYKYVSELWRRKQSDVMRFVQRVRCWEYRQQPAIVRLTRPTRPDKARRLGYKAKQGYVVYRVRVRRGGRKRPVPKGIVYGKPKHQGITQLKFQRNKRSVAEERAGRKLGGLRVLNSYWVNEDSTYKYFEIILVDVAHTTIRNDPRINWLCNPVHKHRELRGLTSAGKKFRGLRGKGHTHHKNRPSRRATWKRNQTLSLRRYR

SEQ ID NO: 607 - DNA, 819 bp, Zea mays
  CDS (1)..(819)
atgacgggctcaatggatctcccggccaagggcgggttcagcttcgacctgtgccgccgcaacagtatgctggagaagaacgggctcaaactcccgggattcaggaagaccggaacaaccatcgtcggcctcgtctttcaggatggggttgttcttggggcagacacaagagcaactgaggggcctatagttgctgataagaattgtgagaagatccactttatggcgccaaacatttattgttgtggagcaggaactgctgctgacactgaggctgttacagacatggtcagctcgcagctacagctgcaccgttacgcaacgggtcgcgaatctagagtcgtaactgctcttacactgctgaagtcacatctctttaggtatcaaggccatgtcagtgctgcccttgttcttggtggagtggattgtactggaccgcatcttcacactgtttatccacacggctccactgatactcttccttttgccacgatgggttctggatcccttgctgcaatgtcagtgtttgaatcgaagtataaagagggcctcactagggaagagggaatacaactggtgtcagaagcaatatgtgcaggtatcttcaatgacttgggtagtggaagcaatgtggatgtctgcgtgataaccaaggggaagacagaatacttgagaaaccaccagttgccgaatcccagaacttatgttagttcaaagggatatagcttcaccaaggggcagactgaggtgctgtccgcaaagatcacacatctcaagcagaaggttgaggtcactgagggcggtgatgctatggagtga

SEQ ID NO: 608 - protein, 272 aa, Zea mays
MTGSMDLPAKGGFSFDLCRRNSMLEKNGLKLPGFRKTGTTIVGLVFQDGVVLGADTRATEGPIVADKNCEKIHFMAPNIYCCGAGTAADTEAVTDMVSSQLQLHRYATGRESRVVTALTLLKSHLFRYQGHVSAALVLGGVDCTGPHLHTVYPHGSTDTLPFATMGSGSLAAMSVFESKYKEGLTREEGIQLVSEAICAGIFNDLGSGSNVDVCVITKGKTEYLRNHQLPNPRTYVSSKGYSFTKGQTEVLSAKITHLKQKVEVTEGGDAME

SEQ ID NO: 609 - DNA, 906 bp, Zea mays
  CDS (1)..(906): n means a or g or c or t/u
atgagaaatcgagcctcactcgatccatcgcctcgccgcagcacanacgaggccggcggcgccatggccatgaagctggacatgtccgcgctcgagaccaacttcgccaacctgaccgcctccgccggcgacgacacgtacttctccgccgaggcccccgacgtgccgtccatggtgctccccatctgcgacgacttcgacggcttccaggcggccaccaaggatatggtgaagaataagaaggggacgaccacgcttgccttcatcttcgacaagggcgtcatcgtcgccgctgattccagggccagcatgggcggttatatatcctcacaaaccgtgaggaaaattattgaaataaatccttacatgctggggacaatggctggaggtgctgctgattgccaattttggcataggaacctaggaaccaagtgtcgtctccatgagctttcaaacaagcgaaggatctctattgctggtgcttccaaactgttggctaacatcctttattcatatcgtgggatgggactgtcgattggtacaatgatcgctggatgggatgagaagggtcctggcttgtactatgttgacagtgagggtgcgcggctcgtggggaacaggttctctgttggctctggttcactgtatgcttatggtatcttggatgatggttaccgcttcagcatgtcagttgaggaagccgccgaattagcgcgacgggctatttatggggcaacattccgtgatgcagcaagtggtggttgtgttagtgtttaccacgttggccctgatggttggacgaagctttctggggatgatgtcggggagctgcactaccactactacccggttcagaaaactccggttgaacaggagatggccgatgcgcctactgcttctgcttga

SEQ ID NO: 610 - protein, 301 aa, Zea mays
  misc_feature (16)..(16): Xaa can be Asn or His or Asp or Tyr
MRNRASLDPSPRRSTXEAGGAMAMKLDMSALETNFANLTASAGDDTYFSAEAPDVPSMVLPICDDFDGFQAATKDMVKNKKGTTTLAFIFDKGVIVAADSRASMGGYISSQTVRKIIEINPYMLGTMAGGAADCQFWHRNLGTKCRLHELSNKRRISIAGASKLLANILYSYRGMGLSIGTMIAGWDEKGPGLYYVDSEGARLVGNRFSVGSGSLYAYGILDDGYRFSMSVEEAAELARRAIYGATFRDAASGGCVSVYHVGPDGWTKLSGDDVGELHYHYYPVQKTPVEQEMADAPTASA

SEQ ID NO: 611 - DNA, 723 bp, Zea mays; identical to SEQ ID NO: 587
  CDS (1)..(723): n means a or g or c or t/u

SEQ ID NO: 612 - protein, 240 aa, Zea mays; identical to SEQ ID NO: 588
  misc_feature (3)..(3): Xaa can be Lys or Thr or Arg or Met
  misc_feature (200)..(200): Xaa can be Arg or Gln or Leu or Pro
  misc_feature (233)..(233): Xaa can be Ala or Glu or Gly or Val

SEQ ID NO: 613 - DNA, 660 bp, Zea mays
  CDS (1)..(660): d means a or g or t/u, k means g or t/u, y means t/u or c
atgagcaaggtgttcgagggctacgagcgccadtactgcvaggcgtccgcctccctcacccgcaaatgcaccgccgccgccgccctacagggagagaagctgaagcagaaggcggcggagatccaatccggcatcgatggcgctgaggcactgataaggaagatggatcttgaagcaagaaacctgcaaccaagcattagagctgatctcctagtaaagatcagggagtacaagtcagatcttaataaccttaagggagcbctgaagagggttactagtattaatgcacaacagggggcgagggaggagttgttggagtyaggaatggcagatacattgggggtttctgctgatcaaaggtcaagattgctcagggcaaccgagagacagaaccaaacaactgataggctcagagatagccatagaactatgctggagactgaagaacttggtgtctctatcctgcatgacctgagtcaacagcgccagtctctcttgcatgctcatgatgtattggacgaaktggataacaacgtcggcaagagcaggaggaccattggaggcatgatgaggagaatggatagaaacaagttgatcatcggtctcatcatagcagtkcttgtcttggctatcctcgtgattytgtatttcaagttctga

SEQ ID NO: 614 - protein, 219 aa, Zea mays
  misc_feature (11)..(11): Xaa can be Gln or His
  misc_feature (14)..(14): Xaa can be Lys, Glu or Gln
  misc_feature (107)..(107): Xaa can be Leu or Ser
  misc_feature (175)..(175): Xaa can be Val or Leu
MSKVFEGYERXYCXASASLTRKCTAAAALQGEKLKQKAAEIQSGIDGAEALIRKMDLEARNLQPSIRADLLVKIREYKSDLNNLKGALKRVTSINAQQGAREELLEXGMADTLGVSADQRSRLLRATERQNQTTDRLRDSHRTMLETEELGVSILHDLSQQRQSLLHAHDVLDEXDNNVGKSRRTIGGMMRRMDRNKLIIGLIIAVLVLAILVILYFKF

SEQ ID NO: 615 - DNA, 729 bp, Zea mays; identical to SEQ ID NO: 253
  CDS (1)..(729): n means a or g or c or t/u

SEQ ID NO: 616 - protein, 242 aa, Zea mays; identical to SEQ ID NO: 254
  misc_feature (3)..(3): Xaa can be Lys or Thr or Arg or Met
  misc_feature (210)..(210): Xaa can be Ala or Glu or Gly or Val
  misc_feature (214)..(214): Xaa can be Asp or Glu
  misc_feature (233)..(233): Xaa can be Ala or Glu or Gly or Val

SEQ ID NO: 617 - DNA, 579 bp, Zea mays
  CDS (1)..(579)
atggccgaccgccgaccgcggacgatgcctcccaaggccaagaaggacgctgcgccgtctgagcgccccatccttggacgcttctcctcccacctcaagatcgggatcgttgggttgccaaatgttggcaaatcaacttttttcaacatagtaacaaagttggctatcccagctgagaattttcctttctgtaccatcgaaccaaatgaagcacgggtgaatgttccagatgaacggtttgattggctctgcaaactttacaagccaaagagtgaggtgcctgcatatcttgaagtaactgacatagctgggcttattagaggtgctcatgctggggatggtctgggcaatgcattcctctcacatatacgtgctgttgatggaatcttccatgtcctaagagcatttgaagacgcagaaattactcatgttgacgatacagtagatcctgttagagacatggaaactattagtgaagagctcagactaaaggatatagagttcatgaaaaagaaacttgaggaccttgataagtcaatgaagaggagcaatgataagctgctcaaaattgagcattga

SEQ ID NO: 618 - protein, 192 aa, Zea mays
MADRRPRTMPPKAKKDAAPSERPILGRFSSHLKIGIVGLPNVGKSTFFNIVTKLAIPAENFPFCTIEPNEARVNVPDERFDWLCKLYKPKSEVPAYLEVTDIAGLIRGAHAGDGLGNAFLSHIRAVDGIFHVLRAFEDAEITHVDDTVDPVRDMETISEELRLKDIEFMKKKLEDLDKSMKRSNDKLLKIEH

SEQ ID NO: 619 - DNA, 624 bp, Zea mays
  CDS (1)..(624)
atgcgattcagccagattcgattcgacatgaatcccgagtacgactaccttttcaaacttctgcttattggtgattctggtgttgggaaatcatgcttgcttctcagatttgcggatgattcatatttggacagctacatcagcacaattggggttgattttaaaattcggacagtagagcaagatgggaagaccataaaacttcaaatttgggatactgctgggcaagagcgcttcaggaccatcactagcagctactaccgtggagctcatggaatcattattgtatatgacgtgacagaccaagaaagcttcaataatgtgaagcaatggttaaatgaaattgatcgttatgcaagtgacaatgttaacaagctccttgttgggaacaagagcgacctaactgccaacaaagttgtggcaactgagacagcaaaggcatttgctgatgagatgggcatcccgttcatggagacgagtgccaaaaacgccaccaacgtggagcaggccttcatggctatggctgcatccatcaaggacaggatggccagccaaccagccgcggccaacgcaaggccagcgacggtgcagatccgcgggcaacccgtcaaccagaagacgtga

SEQ ID NO: 620 - protein, 207 aa, Zea mays
MRFSQIRFDMNPEYDYLFKLLLIGDSGVGKSCLLLRFADDSYLDSYISTIGVDFKIRTVEQDGKTIKLQIWDTAGQERFRTITSSYYRGAHGIIIVYDVTDQESFNNVKQWLNEIDRYASDNVNKLLVGNKSDLTANKVVATETAKAFADEMGIPFMETSAKNATNVEQAFMAMAASIKDRMASQPAAANARPATVQIRGQPVNQKT

SEQ ID NO: 621 - DNA, 576 bp, Zea mays
  CDS (1)..(576)
atggcaaaccctagcgccagccacccacccacccactcgcttcagccgcctccgccgcgcgtacaagcaggtggagacaggatgccggctggccacggcctgcgctcgcggacgcgcgacctcttcgcgcgccccttccgcaagaagggctacatcccgctcaccacctacctccgcacctacaagatcggcgattacgtcgatgtcaaggtgaacggcgccgtccacaaggggatgccgcacaagttctaccacggccgcaccggtcgcgtctggaacgtcaccaagcgcgccatcggcgtcgaggtcaacaagcaggtcaatgggcgcatcatcaggaagcgtatccatgtccgtgtggagcatgtgcagccgtcccgctgcacagaagagttccgcctgaggaaggcgaagaatgaccagctgaaggcggatgccaaaaagcgcggcgaggttatcagcaccaagaggcagccattgggtcccaagcccggcttcatggtcgagggcaccaccattgagaccgtaactcccatcccatatgatgtggtcaatgatctcaagggtggatactga

SEQ ID NO: 622 - protein, 191 aa, Zea mays
MANPSASHPPTHSLQPPPPRVQAGGDRMPAGHGLRSRTRDLFARPFRKKGYIPLTTYLRTYKIGDYVDVKVNGAVHKGMPHKFYHGRTGRVWNVTKRAIGVEVNKQVNGRIIRKRIHVRVEHVQPSRCTEEFRLRKAKNDQLKADAKKRGEVISTKRQPLGPKPGFMVEGTTIETVTPIPYDVVNDLKGGY

SEQ ID NO: 623 - DNA, 1521 bp, Zea mays
  CDS (1)..(1521)
atgcccgcttccgcttcccctcagccgtcacctccccgctcccaccgccaccaatcgcactcgcagtggctgttggcgtgcgctcgcgtccaaaccaagcaaaccccacaaatcctaccttccgccggcgtcgccaccggccgtgctccctccctccggccccggttgaccctagcctcgcatcaccctaaccctacccccctcccgccgctgccagagcaggggaaaaagatgccgcgcgagatcatcacgatccaggtggggcaatgcgggaaccagatcgggatggagttctggaagcagctctgcctcgagcacggcatcggcaaggacggcctcctcgaggacttcgccactcaggggggcgacaggaaggatgtcttcttttaccaggctgatgatcagcacttcatacccaggtctctgcttattgacctggagccgagagtgatcaatgggattcagaacagcgagtacaggaacctgtacaaccatgagaacatatttgttgctgagcacggtggtggtgccgggaacaactgggccagtgggtatcatcagggtgaacaatttgttgatgatatcatggacatggttgacagagaagctgatggaagtgatagccttgagggttttgtcctgtgccactctattgctggtggaactggttcaggtatgggttcttatctattggagacactgaatgatcgatacagtaaaaagcttgtgcagacatatagtgttttcccaaatcaggtggaaacaagtgatgttgtcgtccaaccttacaactcacttttgactctgaagcggctgacactgaatgctgactgtgtggttgttcttgacaatacggctcttaataggattgccgtcgagcgccttcatctatcaaatcctacgtttgcacaaacaaactctttggtctccacggttatgtctgcaagcacaactactttaaggtatcctggatatatgaacaatgatctggttggccttcttgcctccttgattcccactccaaggtgtcattttttgatgacaggttatactccgttgactgtcgagcgccaggttaacatgatacgcaaaacgacggtattggatgttatgagaagacttctgcagacaaagaatataatggtgtcatcatatgctcgaacaaaagaagctagccaggctaaatacatctccatattgaacatcattcaaggggaggtggaccctacacaggttcacgagagcctgcaaagaatacgcgaaaggaagcttgttaactttatagactgggcacctgcaagcattcaggttgctttgtcaagaaaatccccttatgttcaaacaacccacagggttagtggtctgatgttagcaaatcatacaagcatccgtcatttattcagcaaatgcctgggacaatatgaaaagctaaggaaaaagcaggcttttcttgacaactacaggaagttcccaatgtttgcggacaatgatctatctgaatttgatgaatctcgagagtga

SEQ ID NO: 624 - protein, 506 aa, Zea mays
MPASASPQPSPPRSHRHQSHSQWLLACARVQTKQTPQILPSAGVATGRAPSLRPRLTLASHHPNPTPLPPLPEQGKKMPREIITIQVGQCGNQIGMEFWKQLCLEHGIGKDGLLEDFATQGGDRKDVFFYQADDQHFIPRSLLIDLEPRVINGIQNSEYRNLYNHENIFVAEHGGGAGNNWASGYHQGEQFVDDIMDMVDREADGSDSLEGFVLCHSIAGGTGSGMGSYLLETLNDRYSKKLVQTYSVFPNQVETSDVVVQPYNSLLTLKRLTLNADCVVVLDNTALNRIAVERLHLSNPTFAQTNSLVSTVMSASTTTLRYPGYMNNDLVGLLASLIPTPRCHFLMTGYTPLTVERQVNMIRKTTVLDVMRRLLQTKNIMVSSYARTKEASQAKYISILNIIQGEVDPTQVHESLQRIRERKLVNFIDWAPASIQVALSRKSPYVQTTHRVSGLMLANHTSIRHLFSKCLGQYEKLRKKQAFLDNYRKFPMFADNDLSEFDESRE

SEQ ID NO: 625 - DNA, 846 bp, Zea mays
  CDS (1)..(846)
atgcttgaccctcctcttcactcgcttctcccagaagtcacgcaccaaacaccaccaccaaagaaggcgagaacgtactccgtccctcccctcccctcccctccccttcccctcgaggctccaggaccgtctcctcgcctgctcatccgccgctgcttcccttctctgggctcggagaaccggagagaagcgcgcgcggccatggcgtccagcgcctctcggttcatcaagtgcgtcacggtcggcgacggtgccgtgggcaagacatgtatgctcatctgctacaccagcaacaagttccccactgactacatacctacggtgttcgacaatttcagtgcaaatgtagttgtggatggcaccactgtgaatttgggcctttgggataccgctgggcaggaagattacaaccgcctgaggcctctaagctaccgtggtgcagatgttttcgtgcttgcattctcacttgtgagtcgagctagctatgagaatatcatgaagaagtggataccagagcttcaacattatgcacctggggtgcccgttgttttggcaggcacaaaattggatcttcgtgaagacaagcactacttgatggaccatcctggattggtgcctgttaccactgcacagggggaggaacttcgtagacaaattggtgctatgtattacattgaatgcagctcaaagacacagcagaatgtcaaagctgtgttcgatgctgccatcaaggtagtaatccagcctccaactaaaataagagaaaagaagaagaaaaaatcacgcaaaggatgttctatgatgaacatcttcggtggaagaaaaatgctatgcttcaagtcctga

SEQ ID NO: 626 - protein, 281 aa, Zea mays
MLDPPLHSLLPEVTHQTPPPKKARTYSVPPLPSPPLPLEAPGPSPRLLIRRCFPSLGSENRREARAAMASSASRFIKCVTVGDGAVGKTCMLICYTSNKFPTDYIPTVFDNFSANVVVDGTTVNLGLWDTAGQEDYNRLRPLSYRGADVFVLAFSLVSRASYENIMKKWIPELQHYAPGVPVVLAGTKLDLREDKHYLMDHPGLVPVTTAQGEELRRQIGAMYYIECSSKTQQNVKAVFDAAIKVVIQPPTKIREKKKKKSRKGCSMMNIFGGRKMLCFKS

SEQ ID NO: 627 - DNA, 345 bp, Zea mays
  CDS (1)..(345)
atgaggtttcctcgcccgcaacgcgatgccgaagaacaagggaaagggaggcaagaaccggaagcggggcaagaacgaggcggacgacgagaagcgggactggtgttcaaggaggacgggcaggagtacgcgcaggtgacgcggatgctgggcaacggccgctgcgaggcgctctgcatcgacggcaccaagcgcctctgccacatccggggcaagatgcacaagaaggtgtggatcgccgccggggacatcgtgctcgtcggcctgcgcgactaccaggacgacaaggcggacgtcatcctcaagtacatgaacgacgaggcccgcctgctcaaggcctactga

SEQ ID NO: 628 - protein, 114 aa, Zea mays
MRFPRPQRDAEEQGKGRQEPEAGQERGGRREAGLVFKEDGQEYAQVTRMLGNGRCEALCIDGTKRLCHIRGKMHKKVWIAAGDIVLVGLRDYQDDKADVILKYMNDEARLLKAY

SEQ ID NO: 629 - DNA, 348 bp, Zea mays; identical to SEQ ID NO: 541
  CDS (1)..(348)

SEQ ID NO: 630 - protein, 115 aa, Zea mays; identical to SEQ ID NO: 542

SEQ ID NO: 631 - DNA, 453 bp, Zea mays
  CDS (1)..(453)
atgaacagaaagcagcagcctgttgaatggtaccaaaggagtctgggcagattcgatgaacagatagaactacaaactggattcaactgcaatcagtgtccagaacacgcaaagccgtacagattcacacagcaggggaagcaaggagtttcgatgacacaaatggagataagggtggcagcagggggactcaaacgttcagcagctacagctagtacggtttcttcatggggaagacgaaggaaacaagacctgcactgcctttctaatatgcgatgcacggtttggtttcctccttcaattcccgcggggttactataccgttaccgcaggctttactcacttggccatcatgaccttgacgaactcctcgtagttgatctggccatcgccatcaacgtcggcctcgcggatcatctcgtcgacctcctcgtcggtcagcttctcgcctga

SEQ ID NO: 632 - protein, 150 aa, Zea mays
MNRKQQPVEWYQRSLGRFDEQIELQTGFNCNQCPEHAKPYRFTQQGKQGVSMTQMEIRVAAGGLKRSAATASTVSSWGRRRKQDLHCLSNMRCTVWFPPSIPAGLLYRYRRLYSLGHHDLDELLVVDLAIAINVGLADHLVDLLVGQLLA

SEQ ID NO: 633 - DNA, 1371 bp, Zea mays
  CDS (1)..(1371)
atgattcggcacgacccgcgtcgcagacatgcggccgctttccgaaccgctcgctgctggctcctccgcgcgcgtgttcgcggcatggccacgcttccaatggcgctctcccccgccgccatttcccccttcaccaccctccccctctactattcttcgcgtcctcaccgccgcctcctcgcccgcttcttctccgtcgcttcggcaccgggcggagcgaaagggcaccgaccggcggcctccgccgttgaggtgggcggcgtcaagatcgcgcgcgaggatgttgtgaaggaggatgatccgacaaacaacgtgcccgacaatatcttttcgaagatcggcctgcagctgcacaggagggataaccatccccttgggattttgaagaacacaatttatgattactttgacaagaacttcactgggcagtttgacaagtttgatgacctttgccctcttgtttctgtcaagcagaattttgatgatgtcttggtcccttctgaccatgtaagccggagttacaacgacacatattatgttgatggtcaaacagtcttaaggtgtcataccagtgctcatcaagctgagctgctaaggcatggacatacacactttcttgtaactggagatgtttaccgtagggattccattgattcaactcactatcctgtcttccatcagatggaagggttccgtgtcttctctcctgatgaatggtcagggtctcgcatgggtgggacagcatatgcagctgcagaactcaagaaaacactggaaggcttggcaagacatctatttggtgctgtagagatgcgatgggttgacacttacttcccatttaccaacccatcctttgagctcgaaatatactttcaggatgattggttagaggttttgggctgtggagtcaccgagcaggaaattttgaaaagaaatggcaggagagatcatgtggcatgggcctttggattgggattggagcgtcttgcgatggtccttttcgacattccagatattcgactattctggtcgaatgataaacggttcacgtcccagttctcagaaggcaagcttggtgtcaagttcaagccattttcaaagtttcctccttgttacaaggatatgagtttctggatcaatgatgcatttacagaaaacaacttatgtgaggttgtcagaggaattgctggtgatcttgttgaggaggtaaaacttattgataatttcaccaacaagaaaggcatgacaagtcattgctacagaatagcatataggtcaatggaacgttcgctcacagacgaggagattaacaatcttcagttgaatgtcagggaagctgtgaaagataaattgaaagtagagttgagatga

SEQ ID NO: 634 - protein, 456 aa, Zea mays
MIRHDPRRRHAAAFRTARCWLLRARVRGMATLPMALSPAAISPFTTLPLYYSSRPHRRLLARFFSVASAPGGAKGHRPAASAVEVGGVKIAREDVVKEDDPTNNVPDNIFSKIGLQLHRRDNHPLGILKNTIYDYFDKNFTGQFDKFDDLCPLVSVKQNFDDVLVPSDHVSRSYNDTYYVDGQTVLRCHTSAHQAELLRHGHTHFLVTGDVYRRDSIDSTHYPVFHQMEGFRVFSPDEWSGSRMGGTAYAAAELKKTLEGLARHLFGAVEMRWVDTYFPFTNPSFELEIYFQDDWLEVLGCGVTEQEILKRNGRRDHVAWAFGLGLERLAMVLFDIPDIRLFWSNDKRFTSQFSEGKLGVKFKPFSKFPPCYKDMSFWINDAFTENNLCEVVRGIAGDLVEEVKLIDNFTNKKGMTSHCYRIAYRSMERSLTDEEINNLQLNVREAVKDKLKVELR

SEQ ID NO: 635 - DNA, 516 bp, Zea mays
  CDS (1)..(516)
atgcaagcaggagcagcaaggatgccggctggccacgggctgcgctcgcggacgcgcgacctgttcgcgcgccccttccgcaagaagggctacatcccgctcaccacctacctccgcacctacaagatcggcgactacgtcgacgtcaaggtgaacggcgccgtccacaaggggatgccgcacaagttctaccacggccgcaccggtcgcgtctggaacgtcaccaagcgcgccatcggcgtcgagataaacaagcaggtgaatggtcgcatcatcaggaagcgtatccatgtccgcgtggagcatgtgcagccgtcccgctgcacagaagagttccgcctgaggaaggtgaagaatgaccagctgaaggcggatgcaaaggagcgcggcgaggtcatcagcaccaagaggcagccgttgggccccaagcctggcttcatggttgaggggactaccatcgagaccgtcactcccatcccgtacgatgtggtcaatgatcttaagggaggatactga

SEQ ID NO: 636 - protein, 171 aa, Zea mays
MQAGAARMPAGHGLRSRTRDLFARPFRKKGYIPLTTYLRTYKIGDYVDVKVNGAVHKGMPHKFYHGRTGRVWNVTKRAIGVEINKQVNGRIIRKRIHVRVEHVQPSRCTEEFRLRKVKNDQLKADAKERGEVISTKRQPLGPKPGFMVEGTTIETVTPIPYDVVNDLKGGY

SEQ ID NO: 637 - DNA, 789 bp, Zea mays
  CDS (1)..(789)
atggaagataagcaaagcaaggcaaccgttgtcgttgtctctgttcctccgcttcctgctctcttggcttgctgcttgccctcggagcagtgccttccgccgccgccgccgccgcctgttgtgagaaggagaggccggggctgggaggagatgagcgtgaccaagttcatcaagtgcgtcacggtgggggacggcgcggtgggcaagacctgcatgctcatctgctacaccagcaacaagttccccacggattacatccccacggtgttcgacaacttcagcgccaacgtctccgtggacggcagcatcgtcaacctgggcctctgggacactgcaggacaagaggactacagcagattgcggccactgagctacaggggcgcggacgtgttcgtgctggccttctccttgatcagcagggcgagctatgagaacgtccttaagaagtgggtgccagagcttcgcagattcgcgcccgacgtcccggtcgttcttgtcgggaccaagttagatctccgtgaccacagggcctaccttgctgaccatcctggagcgtcgacgatcacgacggcacagggcgaagaactgaggaggcagatcggcgctgcggcttacatcgagtgcagttccaaaacgcagcagaatgtcaagtcggtcttcgacacagccatcaaagtggtccttcagcccccgcggaggagggaggcgacgcctgccaggaggaagaacaggcgtggctccgggtgctctatcatgaacctcatgtgtggcagcacgtgcgctgcttga

SEQ ID NO: 638 - protein, 262 aa, Zea mays
MEDKQSKATVVVVSVPPLPALLACCLPSEQCLPPPPPPPVVRRRGRGWEEMSVTKFIKCVTVGDGAVGKTCMLICYTSNKFPTDYIPTVFDNFSANVSVDGSIVNLGLWDTAGQEDYSRLRPLSYRGADVFVLAFSLISRASYENVLKKWVPELRRFAPDVPVVLVGTKLDLRDHRAYLADHPGASTITTAQGEELRRQIGAAAYIECSSKTQQNVKSVFDTAIKVVLQPPRRREATPARRKNRRGSGCSIMNLMCGSTCAA

SEQ ID NO: 639 - DNA, 693 bp, Zea mays; identical to SEQ ID NO: 581
  CDS (1)..(693)

SEQ ID NO: 640 - protein, 230 aa, Zea mays; identical to SEQ ID NO: 582

SEQ ID NO: 641 - DNA, 468 bp, Zea mays
  CDS (1)..(468)
atgcccaccaccgagcccatggcggaccagctcaccgacgaccagatcgccgagttcaaggaggccttcagcctcttcgacaaggacggggatggttgcatcacgaccaaggagctgggcactgtcatgcgctcgctggggcaaaatcctacagaggctgagctccaggacatgatcaacgaggtcgatgctgatggcaacggcaccatcgatttcccagagtttctcaaccttatggctcgcaagatgaaggacaccgactctgaggaagagctcaaggaggccttccgtgtgtttgacaaggaccagaacggcttcatctcggccgccgagctccgccatgtcatgacaaatcttggtgagaagctaactgatgaggaggtggacgagatgatccgtgaggctgatgtcgatggtgatggccagatcaactacgaggagtttgtcaaggtcatgatggccaagtga

SEQ ID NO: 642 - protein, 155 aa, Zea mays
MPTTEPMADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 643 - DNA, 666 bp, Zea mays
  CDS (1)..(666)
atgagcaaggtgttcgagggctacgagcgccagtactgcgaggcgtccgcctccctcacccgcaaatgcaccgccgccgccgccctacagggagagaagctgaagcagaaggcggcggagatccaatccggcatcgatggcgctgaggcactgataaggaagatggatcttgaagcaagaaacctgcaaccaagcattagagctgatctcctagtaaagatcagggagtacaagtcagatcttaataaccttaagggagcgctgaagagggttactagtattaatgcacaacagggggcgagggaggagttgttggagtcaggaatggcagatacattgggggtttctgctgatcaaaggtcaagattgctcagggcaaccgagagacagaaccaaacaactgataggctcagagatagccatagaactatgctggagactgaagaacttggtgtctctatcctgcatgacctgagtcaacagcgccagtctctcttgcatgctcatgatgtattggacgaggtggataacaacgtcggcaagagcaggaggaccattggaggcatgatgaggagaatggatagaaacaagtggatcatcggtctcatcatagcagttcttgtcttggctatcctcgtgattctgtatttcaagttcgtgcactga

SEQ ID NO: 644 - protein, 221 aa, Zea mays; identical to SEQ ID NO: 578

SEQ ID NO: 645 - DNA, 1176 bp, Zea mays
  CDS (1)..(1176)
atgggctgccctgcctcgagctcatcatgctcatcagcaagccggccggctcggtggtgtaccgccagaacgcgaggacccccgggcacgacgacggcaggcgctacaactttcgcccaattccccactagcaaccgtccccacaatcctccgacgatgcctgccgcgccgacgctgttgcccccgtgcgacgcggaggagccgctgctggcggagtcctccgaccgcttctccatgttcccgatccgtttcccgcagatctgggagttctacaagaaggcggtggcctccttctggacggcggaggaggttgacctctctgccgacgcccggcactgggacgaggcgctgtcccccgacgagcggcacttcatctcccacgtgctcgccttcttcgctgcctccgacggcatcgtgctcgagaacctcgcttcccgcttcatgaccgacgtgcaggtcgccgaggcgcgggccttctacggcttccagatcgccatcgagaacatccactcggagatgtattcgctgctgctcgagacctacatccgcgaccacgtcgagaaggaccgcctgttccgcgccatcgacaccgtgcccgcggtccggcgcaaggctgactgggccatgcgctggatcgacggcggggagcgcttcgctgagcgcatcgttgccttcgcctgcgtcgagggcatattcttctcggggtccttctgcgccatcttctggctcaagaagcgcgggctcatgccgggcctcaccttctccaacgagctcatctcccgcgatgagggcctccactgtgatttcgcctgcctcctctacgagcttctccgcaacaagctcgacgaggcccgcgtccgcgagatcgtcgcagacgctgtcgacatcgagcgcgagttcgtctgcgacgccctccctgtcgcgctcgtcggcatgaacggggatctcatgagccagtacattgaattcgtggccgaccgcctgctcatggcgctcgggtgcaagaagatgtacaacgtgaccaatcccttcgactggatggagctcatctcgctgatggggaagaccaacttcttcgagaagcgcgtgggtgactaccagaaggcatccgtcatgaacagcctcaacggcggcggggctgccgaccacgtcttcagcatcgatgaggacttctga

SEQ ID NO: 646 - protein, 391 aa, Zea mays
MGCPASSSSCSSASRPARWCTARTRGPPGTTTAGATTFAQFPTSNRPHNPPTMPAAPTLLPPCDAEEPLLAESSDRFSMFPIRFPQIWEFYKKAVASFWTAEEVDLSADARHWDEALSPDERHFISHVLAFFAASDGIVLENLASRFMTDVQVAEARAFYGFQIAIENIHSEMYSLLLETYIRDHVEKDRLFRAIDTVPAVRRKADWAMRWIDGGERFAERIVAFACVEGIFFSGSFCAIFWLKKRGLMPGLTFSNELISRDEGLHCDFACLLYELLRNKLDEARVREIVADAVDIEREFVCDALPVALVGMNGDLMSQYIEFVADRLLMALGCKKMYNVTNPFDWMELISLMGKTNFFEKRVGDYQKASVMNSLNGGGAADHVFSIDEDF

SEQ ID NO: 647 - DNA, 657 bp, Zea mays
  CDS (1)..(657): n means a or g or c or t/u
atgccttacctcgtcgccgccagccgtgnagagagagaagaggaagaggaggaggaggcggagatggcaccggtgtcggcgctcgccaagtacaagctcgtcttcctgggggaccagtccgtcggcaagaccagcatcatcacccgcttcatgtacgataagttcgacaacacttaccaggctacaattggtattgatttcctgtcaaagacaatgtaccttgaagatagaactgtgagactccaactctgggatacagctggtcaggaaaggttcaggagtttaattccaagctatatcagagactcttcagttgctgtcattgtattcgatgttgcaagcaggcagtctttcttaaatacatccaagtggatagatgaagttcgcactgagaggggcagtgatgttatcattgtgcttgttgggaacaaaactgaccttgttgacaagaggcaagtctcgatagaggaaggagaaggcaaggcaaaggaccttggtgtcatgtttattgaaaccagtgctaaagctgggtttaacattaaggcgctgttccgtaaaattgctgctgcccttcctggtatggagacactctcatcagcgaagcaggaagacatggttgatgtgaacttgaggtctggcaatgcaaactcgtcctga

SEQ ID NO: 648 - protein, 218 aa, Zea mays
  misc_feature (10)..(10): Xaa can be Ala or Glu or Gly or Val
MPYLVAASRXEREEEEEEEAEMAPVSALAKYKLVFLGDQSVGKTSIITRFMYDKFDNTYQATIGIDFLSKTMYLEDRTVRLQLWDTAGQERFRSLIPSYIRDSSVAVIVFDVASRQSFLNTSKWIDEVRTERGSDVIIVLVGNKTDLVDKRQVSIEEGEGKAKDLGVMFIETSAKAGFNIKALFRKIAAALPGMETLSSAKQEDMVDVNLRSGNANSS

SEQ ID NO: 649 - DNA, 858 bp, Zea mays
  CDS (1)..(858)
atggaattcccgggcgagatttcgtccgagaccaccaccgctctgcctcgcctcgcctcacctcacctcacctcacctcgccgactagggttttgtaccgccgtggatctcgccgtccccgccatggacgtctcgcacgcgggatcctccgtcgccggcgaggctccgaccaccggggagcaccggatggggactaccatcgtcggggtctgctacgagggcggcgtcgtcctgggcgccgattccaggaccagcactggaatgtatgtagccaaccgtgcttcagacaagattactcaactgacagacaatgtgtatgtctgtcgctctggatctgctgctgatacacaagtcatttcggattatgtacgctatttcctccaccaacacacaatccagcttggacaaccagctaccgttaaagttgcagctaacttgattaggttgctagcttatcagaataagaacatgttgcaagctggcatgattgttggaggatgggacaagtacgagggaggccaaattttctcagtccctctcggtggaacgatcttgaagcaaccatttgcaattggaggttcaggttccagttacctatatgctcttcttgatcatgaatggaaagagggaatgagtcaggaagaggcagagaaatttgtggtgaaggtagtttcccttgctatggcccgtgatggtgctagtggaggggttgtccgtacagttacaataaatgcggatggcgtgaagaggaacttttaccctggcgacaagctacccctgtggcacgacgagctggaaccccagaactcgttgcttgatattcttgctgctgggaaccctgatcccatggtgcagtga

SEQ ID NO: 650 - protein, 285 aa, Zea mays
MEFPGEISSETTTALPRLASPHLTSPRRLGFCTAVDLAVPAMDVSHAGSSVAGEAPTTGEHRMGTTIVGVCYEGGVVLGADSRTSTGMYVANRASDKITQLTDNVYVCRSGSAADTQVISDYVRYFLHQHTIQLGQPATVKVAANLIRLLAYQNKNMLQAGMIVGGWDKYEGGQIFSVPLGGTILKQPFAIGGSGSSYLYALLDHEWKEGMSQEEAEKFVVKVVSLAMARDGASGGVVRTVTINADGVKRNFYPGDKLPLWHDELEPQNSLLDILAAGNPDPMVQ

SEQ ID NO: 651 - DNA, 654 bp, Zea mays
  CDS (1)..(654)
atgagcgcggcggcggcgagctcggtcaccaagttcatcaagtgcgtcacggtcggcgatggggccgtcgggaagacctgcatgctcatctgctacacctgcaacaagttccccacggattatatccccaccgtatttgacaacttcagcgccaatgtctccgtgggtgggagcatcgtcaacttgggcctctgggacacggcaggccaggaggattacagcaggttgaggcctctcagctacaggggtgctgatgtgttcatcctctccttctccctggtcagcagggcgagctatgagaacgtcctcaagaagtggatgccagagcttcgccgattttcacctactgttcctgtagttcttgttggaaccaaactagatctccgtgaagacagatcttaccttgctgaccattctgctgcttccatcatctctgctgaacagggagaagagctcaggaagcagataggtgctgtggcgtacatagaatgcagctcaaagacacagaggaacgtaaaggctgtgttcgacactgcaattaaagtagtgctgcaaccaccgaggagaagagaagttaccacgaagaaaatgaagacaagttcgaaccagtctctgagaagatacctctgtggaagcggatgtttcacatcgtga

SEQ ID NO: 652 - protein, 217 aa, Zea mays
MSAAAASSVTKFIKCVTVGDGAVGKTCMLICYTCNKFPTDYIPTVFDNFSANVSVGGSIVNLGLWDTAGQEDYSRLRPLSYRGADVFILSFSLVSRASYENVLKKWMPELRRFSPTVPVVLVGTKLDLREDRSYLADHSAASIISAEQGEELRKQIGAVAYIECSSKTQRNVKAVFDTAIKVVLQPPRRREVTTKKMKTSSNQSLRRYLCGSGCFTS

SEQ ID NO: 653 - DNA, 495 bp, Zea mays
  CDS (1)..(495)
atgccggcggggcacgggctgcggtcgcggacccgcgacctgttcgcgcggccctttcgcaagaaggggtacatcccgctcaccacgtacctgcgcacctacaagatcggcgactacgtcgacgtcaaggttaacggcgccgtgcacaagggcatgccgcacaagttctaccacggccgcaccgggagcgtctggaacgtcaccaagcgcgccatcggcgtcgagatcaacaagcaggttaatggccgcatcatcaggaagcggatccatgtccgcgtggagcatgtgcagccctcccgttgcacagaggagttccgcctgaggaaagccaagaatgaccagctcaaggcggatgccaaggcccgcggtgaggtgatcagcaccaagaggcagcctgtgggacccaaacctggcttcatggtcgagggtgctacactagagacagtcactcctattccttatgatgtggtcaacgatctcaagggcggttactga

SEQ ID NO: 654 - protein, 164 aa, Zea mays; identical to SEQ ID NO: 306

SEQ ID NO: 655 - DNA, 639 bp, Zea mays
  CDS (1)..(639)
atgagcgtgaccaagttcatcaagtgcgtcacggtgggcgacggcgcggtgggcaagacctgcatgctcatctgctacaccagcaacaagttccccacggactacatccccacggtgttcgacaacttcagcgccaacgtctccgtggacggcagcatcgtcaacctgggcctctgggacaccgcggggcaagaggactacagcaggctgcggccgctgagctacaggggcgcggacgtgttcgtgctggccttctccctgatcagcagggcgagctacgagaacgttcttaagaagtgggtgccagagcttcgcagattcgcgcccaacgtcccggtcgttcttgttgggaccaagttagatctccgcgaccacagagcctacctcgccgaccatcctggagcttcagcagtcaccacggcgcagggtgaggaactgaggaagcagatcggcgctgcggcctacatcgagtgcagttccaaaacccagcagaacgtcaagtctgtcttcgatacggccatcaaagtggtccttcagcccccacggaggagggaggcagtgcctgccaggaagaagaacaggcgtggctccggatgctctataatgaaccttgtgtgtggcagcacatgtgctgcttga

SEQ ID NO: 656 - protein, 212 aa, Zea mays
MSVTKFIKCVTVGDGAVGKTCMLICYTSNKFPTDYIPTVFDNFSANVSVDGSIVNLGLWDTAGQEDYSRLRPLSYRGADVFVLAFSLISRASYENVLKKWVPELRRFAPNVPVVLVGTKLDLRDHRAYLADHPGASAVTTAQGEELRKQIGAAAYIECSSKTQQNVKSVFDTAIKVVLQPPRRREAVPARKKNRRGSGCSIMNLVCGSTCAA

SEQ ID NO: 657 - DNA, 411 bp, Zea mays
  CDS (1)..(411)
atgcgagcgcctccggctgatcggttggtgttgaggcgagtggaagcttcgagttttttttttcttccttttggcttactgcgcaagaagaagggtaacaagaggacggcggcgatggcgaagaggctgctcccatctctgaaccgggtgctggttgagaagctggtgcagcccaagaagaccgccggcggcatcctcctcccggaaacatccaagcagctgaatgctgctaaagtggtggctgttggccctggtgagcgcgacaaggcaggcaatctgatcccagttgctctgaaggaaggtgacactgttctcctgccagagtatggtggaactgaagttaagcttgcagctgataaagagtacctcctcttcagagagcacgacattttgggcacacttgtggactga

SEQ ID NO: 658 - protein, 136 aa, Zea mays
MRAPPADRLVLRRVEASSFFFLPFGLLRKKKGNKRTAAMAKRLLPSLNRVLVEKLVQPKKTAGGILLPETSKQLNAAKVVAVGPGERDKAGNLIPVALKEGDTVLLPEYGGTEVKLAADKEYLLFREHDILGTLVD

SEQ ID NO: 659 - DNA, 765 bp, Zea mays
  CDS (1)..(765)
atggcgtcggtgcaggtctccggcgcgggggtcggtaccgcggccttctctgtgaaggggaaggcctccaccggtgcgctccggcttcgctctacgttgaccttcggcgaggtctgcccggcgcggcgggcgttccgcggcctcgtcgtcagggccgctaccgtcgtcgcccccaagtatacaacacttaagcccttggctgatagagtgcttgtaaagattaactcttccgaggagaagacaactggtggaatcttgctccctacgactgctcagtccagacctcaaggtggcgaggtagttgctgttggagaaggaaggataattggggataagaaagttgatgtcagcattcaggttggagctcaggttgtgtattctaagtacgctggaaccgaggtcgcgttgaacgatcacagccatctggttctcaaagaggatgacgttataggtatcttagaaactgatgacgtgaaagacatgaagcctctgaacgaccgtgttctaatcaaggttgctgaagctgaagacaaaactccaggaggcctactgcttacggaaactgccaaggagaagccatctatcggaacggtcgtagcggttggcccaggccccctggacgaggatggcgagaggctcgcgctgtccgtctccgcggggagcactgtcctgtactccaagtacgccggcagcgagttcaagggcgccgacggcacgaactacatcgtgctgagggcgtcggatctgatggccgttctctcctga

SEQ ID NO: 660 - protein, 254 aa, Zea mays
MASVQVSGAGVGTAAFSVKGKASTGALRLRSTLTFGEVCPARRAFRGLVVRAATVVAPKYTTLKPLADRVLVKINSSEEKTTGGILLPTTAQSRPQGGEVVAVGEGRIIGDKKVDVSIQVGAQVVYSKYAGTEVALNDHSHLVLKEDDVIGILETDDVKDMKPLNDRVLIKVAEAEDKTPGGLLLTETAKEKPSIGTVVAVGPGPLDEDGERLALSVSAGSTVLYSKYAGSEFKGADGTNYIVLRASDLMAVLS

SEQ ID NO: 661 - DNA, 1362 bp, Zea mays
  CDS (1)..(1362)
atgcggcgccgcagacatgcgcccgcttatccgaaccgctcgctgctggctcctccgcgcgcgtgttcgcggcatggccacgcttcctatggcgctcccccccgccgccatcccccccttcaccaccctccccctgcctccccttcttcgcgtcctcaccgccccctcctcgcccgcttcttctccgtcgcgccggcgccggtcggggcgaaagggctccgaccggcggcctccgccgttgaggtgggcggcgtcaagatcgcgcgcgaggatgttgtgaaagaagatgatccaacaaacaacgtgcccgacaatatctttgcgaagatcggcctgcagctgcacaggagggataaccatccccttgggattttgaagaacacaatttatgattactttgacaagaacttcactgggcagtttgacaagtttgatgacctttgccctcttgtttctgtcaagcagaattttgatgatgtcttggtcccttctgaccatgtaagccggagttacaacgacacatattatgttgatggtcaaacagtcttaaggtgtcataccagtgctcatcaagctgagctgctaaggcatggacatacacactttcttgtaactggagatgtttaccgtagggattccattgattcaactcactatcctgtcttccatcagatggaagggttccgtgtgttctctcctgatgaatggtcaggttctggcttggatgggacagcatatgcagctgcagaactcaagaaaacactggaaggattggcaagacatctatttggtgctgtagagatgcgatgggttgacacttacttcccatttaccaacccatcctttgagctcgaaatatactttcaggatgattggttggaggttttggggtgtggagtcaccgagcaggaaattttgaaaagaaatggcaggagagatcatgtggcatgggcctttggattgggattggagcgtcttgcgatggtccttttcgacattccagatattcgactattctggtcgaatgataaacggttcacgtcccagttctcagaaggcaagcttggtgtcaagttcaagccattttcaaagtttcctccttgttacaaagatatgagtttctggatcaatgatgcatttacagaaaacaacttatgtgaggttgtcagaggaattgccggtgatcttgttgaggaggtaaaacttattgataatttcaccaacaagaaaggcatgacaagtcattgctacagaatagcatataggtcaatggaacgttcgctcacagacgaggagattaacaatcttcagttgaatgtcagggaagctgtgaaagataaattggaagtagagttgagatga

SEQ ID NO: 662 - protein, 453 aa, Zea mays
MRRRRHAPAYPNRSLLAPPRACSRHGHASYGAPPRRHPPLHHPPPASPSSRPHRPLLARFFSVAPAPVGAKGLRPAASAVEVGGVKIAREDVVKEDDPTNNVPDNIFAKIGLQLHRRDNHPLGILKNTIYDYFDKNFTGQFDKFDDLCPLVSVKQNFDDVLVPSDHVSRSYNDTYYVDGQTVLRCHTSAHQAELLRHGHTHFLVTGDVYRRDSIDSTHYPVFHQMEGFRVFSPDEWSGSGLDGTAYAAAELKKTLEGLARHLFGAVEMRWVDTYFPFTNPSFELEIYFQDDWLEVLGCGVTEQEILKRNGRRDHVAWAFGLGLERLAMVLFDIPDIRLFWSNDKRFTSQFSEGKLGVKFKPFSKFPPCYKDMSFWINDAFTENNLCEVVRGIAGDLVEEVKLIDNFTNKKGMTSHCYRIAYRSMERSLTDEEINNLQLNVREAVKDKLEVELR

SEQ ID NO: 663 - DNA, 768 bp, Zea mays; identical to SEQ ID NO: 525
  CDS (1)..(768): n means a or g or c or t/u

SEQ ID NO: 664 - protein, 255 aa, Zea mays; identical to SEQ ID NO: 526
  misc_feature (19)..(19): Xaa can be Lys or Thr or Arg or Met
  misc_feature (31)..(31): Xaa can be Lys or Asn

SEQ ID NO: 665 - DNA, 348 bp, Zea mays
  CDS (1)..(348)
atgtctgatctcgacattcagatcccaactgccttcgatcccttcgctgaggccaatgctggggactctggtgcggcagcagggtcaaaggactacgttcacgtgcgcatccagcagcgtaatggtcgcaagagcctgactaccgtccagggattgaagaaggagttcagctacagcaagatcctcaaagatctcaagaaagagttctgctgcaatggtacagtggtccaggacccagaacttggacaggtcattcagctccagggtgatcagaggaagaacgtctcgaatttcctcgtccaggccggcattgtgaagaaggagcacatcaagattcatggtttctga

SEQ ID NO: 666 - protein, 115 aa, Zea mays
MSDLDIQIPTAFDPFAEANAGDSGAAAGSKDYVHVRIQQRNGRKSLTTVQGLKKEFSYSKILKDLKKEFCCNGTVVQDPELGQVIQLQGDQRKNVSNFLVQAGIVKKEHIKIHGF

SEQ ID NO: 667 - DNA, 471 bp, Zea mays
  CDS (1)..(471)
atgggtttcgtctcgccgctctcgtcctccgcgaagatgccgaagaacaagggtaagggaggcaagaaccggaagcgaggaaagaacgaggctgacgacgacaagcgcgagctcgtcttcaaggaagacgggcaggagtacgcgcaggtgacccggatgctcggcaacgggcggtgcgaggccatctgcgtcgatggcacgcgccgcctctgccatatccggggtaagatgcacaagaaggtctggatcgcggctggggacatcgtcctcgtcggcctccgcgactaccaggacgacaaggccgacgttatcctcaagtacatgaacgacgaggcgcgcctgctcaaggcctacggggagcttcctgacacgctcaggctcaacgagggcgtcgacgtcgatgggcccgaggaaggcgaggagggcagcgactacatccagttcgaggacgaggacatcgacaagatctga

SEQ ID NO: 668 - protein, 156 aa, Zea mays
MGFVSPLSSSAKMPKNKGKGGKNRKRGKNEADDDKRELVFKEDGQEYAQVTRMLGNGRCEAICVDGTRRLCHIRGKMHKKVWIAAGDIVLVGLRDYQDDKADVILKYMNDEARLLKAYGELPDTLRLNEGVDVDGPEEGEEGSDYIQFEDEDIDKI

SEQ ID NO: 669 - DNA, 420 bp, Zea mays
  CDS (1)..(420)
atggagaacccaccagcgcttccttcgccggagcccgagcccgagaccgaggtctcccaggcgccgccgcgaaggctgctgcggctgcgctgcgcggtgcagcactacgagtggggtcagcgtggagcagcctccctcgtcgcgcgcctcgccgaccacaacaaccccgaccctgcccgcccctacgcagagctttggatgggcactcacccgtccggcccatcctcgctcgtcgacgatggctcgcttctcagggactggctcgcgcggaatcacgacgcgctcggccccgccgtcgccgcgcgctggggaggtgacctcccattcctcttcaaggtactacaactggcggacgaacggttccgtggcttggatcgttgcatctttcgtcttccttttgccgtctcgaacgctggttga

SEQ ID NO: 670 - protein, 139 aa, Zea mays
MENPPALPSPEPEPETEVSQAPPRRLLRLRCAVQHYEWGQRGAASLVARLADHNNPDPARPYAELWMGTHPSGPSSLVDDGSLLRDWLARNHDALGPAVAARWGGDLPFLFKVLQLADERFRGLDRCIFRLPFAVSNAG

SEQ ID NO: 671 - DNA, 1251 bp, Zea mays
  CDS (1)..(1251)
atggcacgaggccgcgttggccgccaatcgcagtatcggcaccgttcttccccgcttctccagtccagctcaccagccgccccccctccgctgctgacactgcgaagtgcgaatcaaagccaccaccgcgcacaaaccatggcaccggtggaggcggagcagcaccggcggagggcgttggcgctcgcggcgcacgacgcctccggcgccgtctcccccatccgcatctcgcgaagggacactggagatgacgatgttgccatacagatactgtactgcgggatatgccactctgacctgcacaccatcaagaacgagtggaagaacgccaactaccctgttgtccctgggcacgagatcgccgggctgatcaccgaggttggcaagaacgtgaagaggttcaacgtcggagacaaggttggcgtcgggtgcatggtcaacacatgccagtcctgcgagagctgcgagggagggcacgagaactactgctccaagatcatcttcacctacaactcccacgacagggacggcaccgtcacctacggtggctactctgacatggttgtcgtcaacgagcgcttcgtcatccggttccctgatggcatgcccctcgacagaggcgcgccgctgctctgtgcagggataaccgtgtacaaccccatgaagcaccacgggctaaacgaggcaggcaagcacatcggcgtggttggactcggggggcttgggcacgtcgccgtgaagttcgcgaaggcgttcgggatgagggtgaccgtgatcagcacgtccccggggaagagggaggaagctatggagacgcttggtgcagacgcctttgttgtcagcggtgatgctaaccagatgaaggctgcgaagggcacaatggatggcattatgaacacggcctctgcaagcatgtccatgtacgcttaccttgctctcctcaagccccagggcaagatgatcctgcttggcctgcctgagaagcctctgcagatctctgccttctctttggttactgggggcaagactctggccgggagctgcatggggagcatcagggacacgcaggagatgatggacttcgcagccaagcacgggttgacagcggacatcgaactgatcggcaccgaagaagttaatgaggccatggaacgcctcgccaagggcgaggtcaggtaccgcttcgtcatcgacatcggcaacaccctcaacgcggcatcactagggagctcgccggtcccagctctgtga

SEQ ID NO: 672 - protein, 416 aa, Zea mays
MARGRVGRQSQYRHRSSPLLQSSSPAAPPPLLTLRSANQSHHRAQTMAPVEAEQHRRRALALAAHDASGAVSPIRISRRDTGDDDVAIQILYCGICHSDLHTIKNEWKNANYPVVPGHEIAGLITEVGKNVKRFNVGDKVGVGCMVNTCQSCESCEGGHENYCSKIIFTYNSHDRDGTVTYGGYSDMVVVNERFVIRFPDGMPLDRGAPLLCAGITVYNPMKHHGLNEAGKHIGVVGLGGLGHVAVKFAKAFGMRVTVISTSPGKREEAMETLGADAFVVSGDANQMKAAKGTMDGIMNTASASMSMYAYLALLKPQGKMILLGLPEKPLQISAFSLVTGGKTLAGSCMGSIRDTQEMMDFAAKHGLTADIELIGTEEVNEAMERLAKGEVRYRFVIDIGNTLNAASLGSSPVPAL

SEQ ID NO: 673 - DNA, 729 bp, Zea mays; identical to SEQ ID NO: 253
  CDS (1)..(729): n means a or g or c or t/u

SEQ ID NO: 674 - protein, 242 aa, Zea mays; identical to SEQ ID NO: 254
  misc_feature (3)..(3): Xaa can be Lys or Thr or Arg or Met
  misc_feature (210)..(210): Xaa can be Ala or Glu or Gly or Val
  misc_feature (214)..(214): Xaa can be Asp or Glu
  misc_feature (233)..(233): Xaa can be Ala or Glu or Gly or Val

SEQ ID NO: 675 - DNA, 432 bp, Zea mays
  CDS (1)..(432)
atgcacgaggatgactcaggtgatgaggaatcagatgctagtgatagtggtggtgaaaaggagaaatcatccaagaaggaagcaagcagttcaaagccagttcagaaaagaaagcataaggccagggatgacgaaggacaagagaagaaaaagccaaagaagaaaaaagatccgaatgctccgaaacgagccatgaccccgttcatgtatttctcaatggctgagcgaggaaacatgaagagcagcaacccagatttgcctacgactgagatcgcaaagaagcttggggagatgtggcaaaagatgtcaggcgaagagaaacagccttacatccagcaggcccaggtcgacaagaagcgttatgaaaaagaatccgctgtctatcgcggtgaagctacagtcgatgtggattctgggaacgagtctgactga

SEQ ID NO: 676 - protein, 143 aa, Zea mays
MHEDDSGDEESDASDSGGEKEKSSKKEASSSKPVQKRKHKARDDEGQEKKKPKKKKDPNAPKRAMTPFMYFSMAERGNMKSSNPDLPTTEIAKKLGEMWQKMSGEEKQPYIQQAQVDKKRYEKESAVYRGEATVDVDSGNESD

SEQ ID NO: 677 - DNA, 1020 bp, Zea mays
  CDS (1)..(1020)
atggttggcgcgcgctcccgtcctaaccaagcaaaacccacaaccctagcctccgccggcgccgccatctgccgggcgtccctccggtcccggccgaccgtagcctcgcagcaccctaaccctatccctcccccgctgccgcgggagcagggtaaaaaaatgccgcgtgagatcatcacgatccaggtggggcaatgtggaaaccagatcgggatggagttctggaagcagctctgtctcgagcacggtatcggcaaggacggcctgctcgaggacttcgccactcaggggggcgacaggaaggacgtcttcttttaccaggctgatgatcagcacttcatacccaggtctctgcttattgacctggagccgagagtgatcaatggaatccagaacagtgagtacaggaacctgtacaaccacgagaacatatttgtcgctgagcatggtggtggtgccgggaacaactgggccagtgggtatcatcagggtgaacaagttgttgatgatatcatggacatggttgacagagaagcagatggaagtgatagccttgagggttttgtcctttgtcattctattgctggtggaactggttcaggtatgggttcttatctgttggagacactgaatgatcgatacagtaaaaagcttgtgcagacatatagtgttttcccaaatcagatggaaacaagtgatgttgtcgtccaaccttacaactcacttttaactctgaagcgtctgacactgaatgctgactgtgtggtggttcttgacaatacggctcttaataggattgcggtcgagcgtcttcatttatcaaatcctacatttgcacaaacaaactctttggtctccacagttatgtctgcaagcacaactacattgcggtatcctggatatatgaacaatgatctggttggccttcttgcctccctgatccccactccaaggtgtcattttttgatgacaggctatactccactgactgttgagcgccaggttaacatgatacgctga

SEQ ID NO: 678 - protein, 339 aa, Zea mays
MVGARSRPNQAKPTTLASAGAAICRASLRSRPTVASQHPNPIPPPLPREQGKKMPREIITIQVGQCGNQIGMEFWKQLCLEHGIGKDGLLEDFATQGGDRKDVFFYQADDQHFIPRSLLIDLEPRVINGIQNSEYRNLYNHENIFVAEHGGGAGNNWASGYHQGEQVVDDIMDMVDREADGSDSLEGFVLCHSIAGGTGSGMGSYLLETLNDRYSKKLVQTYSVFPNQMETSDVVVQPYNSLLTLKRLTLNADCVVVLDNTALNRIAVERLHLSNPTFAQTNSLVSTVMSASTTTLRYPGYMNNDLVGLLASLIPTPRCHFLMTGYTPLTVERQVNMIR

SEQ ID NO: 679 - DNA, 579 bp, Zea mays
  CDS (1)..(579): n means a or g or c or t/u
atgacgccgacgcggcgcccgagaagaatttgcggatggattcgctgcgcagcgtgttggagtcgattcaggcgatgcagatccgccccgtggtcgcccaaatcatcaccctangggatgatcctaacttcggcattgatcctatggaaaggattggtcgtcgtaacagggantgagtcgccggttgtggtggttctatctggaagcatggagcctgggtttcgaaagggtgatgtcctgtttctgcacatgaataaggaccctgtccgcacaggagacatagttgttttcaatgtcgagggccgtgatattccaattgtccatcgtgtgatcaaggttcatgagcgccatgatacggtggactctgacattctcacgaaaggtgacaataatcccggggatgaccgagtcctgtacgcacatgggcagctttggctgcagcgacagcacatcattggacgggctgttggctatctgccttatgctgggtggcttacaatcgtcatgacggagaaaccagtcctcaagtatctgctaattggtgcactggggctgctggtggtagcatccaaggagtga

SEQ ID NO: 680 - protein, 192 aa, Zea mays
  misc_feature (38)..(38): Xaa can be any amino acid
  misc_feature (58)..(58): Xaa can be Asn or Thr or Ser or Ile
MTPTRRPRRICGWIRCAACWSRFRRCRSAPWSPKSSPXGMILTSALILWKGLVVVTGXESPVVVVLSGSMEPGFRKGDVLFLHMNKDPVRTGDIVVFNVEGRDIPIVHRVIKVHERHDTVDSDILTKGDNNPGDDRVLYAHGQLWLQRQHIIGRAVGYLPYAGWLTIVMTEKPVLKYLLIGALGLLVVASKE

SEQ ID NO: 681 - DNA, 618 bp, Zea mays
  CDS (1)..(618)
atgtctcgggagctcgccttgtgtcggtacccgggattcggccttatggccgggggacgcgacgcctcaaatcgctccctgcctctggtcacctcgcttccgctcccggctcccctccggccacccagacatcgtccgttcgctcgccaagagacaggaccggagaccatggcggaccagctcaccgacgaccagatcgccgagttcaaggaggccttcagcctcttcgacaaggacggcgacggttgcatcacaaccaaggagctcggaactgtcatgcgatcactgggtcagaacccaaccgaggctgagctccaggacatgatcaacgaggtcgatgcggacggcaacggcaccatcgacttcccggagttcctcaacctcatggcccgcaagatgaaggacaccgactccgaggaggagctcaaggaggcgttcagggtgttcgacaaggaccagaacggcttcatctctgcggcggagctccgccacgtgatgaccaacctcggcgagaagctgaccgacgaggaggtcgatgagatgatccgcgaggccgatgtcgatggtgatggccagatcaactacgaggagttcgtcaaggtcatgatggccaagtga

SEQ ID NO: 682 - protein, 205 aa, Zea mays
MSRELALCRYPGFGLMAGGRDASNRSLPLVTSLPLPAPLRPPRHRPFARQETGPETMADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 683 - DNA, 315 bp, Zea mays
  CDS (1)..(315)
atgacgaggctttcccgcggcgacggtgacgacgaccgcgcgagcgccgccgactccctactgcatcaggtgcctcggccttcgtcgtgctctccgccggcaacgagtatagacgggcgcgcatggccaccttcgagctgtaccggaggtccaccatcggcatgtgcctcaccgagacgctcgacgagatggtctccaacggcaccctcagcccggagctcgctatccaggtcctcgtccagttcgacaaggtggagatgcctcgtgcccccctttttttccttgtctcggactgtggggaaatctggtcattga

SEQ ID NO: 684 - protein, 104 aa, Zea mays
MTRLSRGDGDDDRASAADSLLHQVPRPSSCSPPATSIDGRAWPPSSCTGGPPSACASPRRSTRWSPTAPSARSSLSRSSSSSTRWRCLVPPFFSLSRTVGKSGH

SEQ ID NO: 685 - DNA, 399 bp, Zea mays
  CDS (1)..(399): n means a or g or c or t/u
atgacatggcggagctcggcggccgagatgaagccgttctggtccttgtcaaacacacggaaggcctccttgagctcttcctcagagtcggtgtccttcatcttgcangccataaggttgagaaaactctgggaaatcgatggtgccgttgccatcagcatcgacctcgttgatcatgtcctggagctcagcctctgtaggattttgccccagcgagcgcatgacagtgcccagctccttggtcgtgatgcaaccatccccgtccttgtcgaagaggctgaaggcctccttgaactcggcgatctggtcgtcggtgagctggtccgccatgggctcggtggtggggagggagcaggtggatcggangcgacgaaatcgtcgacagcgaagtcgacctga

SEQ ID NO: 686 - protein, 132 aa, Zea mays
  misc_feature (36)..(36): Xaa can be Gln or His
  misc_feature (122)..(122): Xaa can be Asp or Glu
MTWRSSAAEMKPFWSLSNTRKASLSSSSESVSFILXAIRLRKLWEIDGAVAISIDLVDHVLELSLCRILPQRAHDSAQLLGRDATIPVLVEEAEGLLELGDLVVGELVRHGLGGGEGAGGSXATKSSTAKST

SEQ ID NO: 687 - DNA, 501 bp, Zea mays
  CDS (1)..(501)
atgatccaggcggtgatggtgatcagcacccaggccaagccccgccttctcaagttctacagtttccagccacccgagaagcatcaggacctcgtccgctgtgtcttccaattactctctgcaaggcccgagagcgcgagcaattttgtcaaggtggactccatctttggcccgggaacaaaaatggtctacaagcatttggccacactatactttgtttttgtctttgatagctctgagaacgagcttgccatgctcgacctcgtacaagtgtttgttgaaacattggacagatgcttcaagaatgtatgcgagcttgacatcgtatttaacttcaacaagctgcacaccattttggatgagatgatatcggggggacaggtgatcgaaacaagttcagaacagataatgaaatctgtggaagagattgaaaggctggagaaacaatcgagcacaaccagcttcatacccaagtcgattacagagcgttttacccgttga

SEQ ID NO: 688 - protein, 166 aa, Zea mays
MIQAVMVISTQAKPRLLKFYSFQPPEKHQDLVRCVFQLLSARPESASNFVKVDSIFGPGTKMVYKHLATLYFVFVFDSSENELAMLDLVQVFVETLDRCFKNVCELDIVFNFNKLHTILDEMISGGQVIETSSEQIMKSVEEIERLEKQSSTTSFIPKSITERFTR

SEQ ID NO: 689 - DNA, 399 bp, Zea mays
  CDS (1)..(399)
atgcgttgctgtcgccggcgcggagaaggagggcggaggctaggcgatggcggacgagaatgtgagttcctccctcagtgcaattcgaagatgcaggaggctgggaagaaggaggaagaggaatttagcacaggccctctgtcagtactaatgatgagtgttaagaacaacacccaggttctcatcaattgccgcaacaacaagaagctgcttggccgggttcgtgcttttgatcgccactgtaacatggtgctcgagaacgtgcgggagatgtggacagaggtccccaagactggcaagggcaaaaagaaggctctgcctgtgaacaaggatagattcatcagcaagatgttcctcaggggcgactcggtcatcatcgtgctgaggaaccccaagtga

SEQ ID NO: 690 - protein, 132 aa, Zea mays
MRCCRRRGEGGRRLGDGGRECEFLPQCNSKMQEAGKKEEEEFSTGPLSVLMMSVKNNTQVLINCRNNKKLLGRVRAFDRHCNMVLENVREMWTEVPKTGKGKKKALPVNKDRFISKMFLRGDSVIIVLRNPK

SEQ ID NO: 691 - DNA, 543 bp, Zea mays; identical to SEQ ID NO: 433
  CDS (1)..(543): n means a or g or c or t/u

SEQ ID NO: 692 - protein, 180 aa, Zea mays; identical to SEQ ID NO: 434
  misc_feature (18)..(18): Xaa can be Thr or Pro or Ala or Ser

SEQ ID NO: 693 - DNA, 660 bp, Zea mays
  CDS (1)..(660)
atggcacgaggaccgccgccgccgtcgcacgcagccgcatccgccatgggggcgtacaagtatgtctcggagttatggaggaggaagcaatccgacgtgatgcggttcgtgcagcgcgtgcgctgctgggagtacaggcagcagccggccatcgtccgcctcacaaggcccacccgccccgacaaggcccgccgcctcggctacaaggccaagcaggggtatgttgtttaccgtgtccgtgtcaagcgtggcggcaggaagaggcctgtgccgaagggtattgtctatggcaagcccaagcaccagggtatcacccagctcaagttccagaggaacaagaggtctgttgctgaggagagggctggacgaaagcttggtggactcagggttctcaactcctactgggtgaatgaggatagcacctacaagtacttcgagatcatcctggttgatgtggctcacaccgccatccgcaacgacccaagaatcaactggctatgcaatcctgtgcacaagcaccgtgagctccgtggtctcacctctgcaggcaagaagttccgtggtctgcgtggcaagggccacactcaccacaagaacaggccgtccaggagggccacctggaagcgcaaccagaccctttccctccgccgctaccgttga

SEQ ID NO: 694 - protein, 219 aa, Zea mays
MARGPPPPSHAAASAMGAYKYVSELWRRKQSDVMRFVQRVRCWEYRQQPAIVRLTRPTRPDKARRLGYKAKQGYVVYRVRVKRGGRKRPVPKGIVYGKPKHQGITQLKFQRNKRSVAEERAGRKLGGLRVLNSYWVNEDSTYKYFEIILVDVAHTAIRNDPRINWLCNPVHKHRELRGLTSAGKKFRGLRGKGHTHHKNRPSRRATWKRNQTLSLRRYR

SEQ ID NO: 695 - DNA, 372 bp, Zea mays
  CDS (1)..(372)
atgcaacaaccaagtatcatgtctgatctcgacgtccagcttccatctgcctttgatccgtttgctgaggcaaatgctgaggactctggtgctggtcctggaacgaaggattatgtgcatgtgcgcatccagcagcgcaacggcagaaagagtctgactacagtccagggtctgaagaatgagttcagctataacaagatcctcaaggatctgaagaaggaattctgctgcaatggtactgtagttcaggacccagagctaggccaggtaagatacgagaacaatgcatttcaagcttgtaaaaatggtatctgccggttggtggatatactgatctgtttgtccgctgcaggtcattcagctccaaggtga

SEQ ID NO: 696 - protein, 123 aa, Zea mays
MQQPSIMSDLDVQLPSAFDPFAEANAEDSGAGPGTKDYVHVRIQQRNGRKSLTTVQGLKNEFSYNKILKDLKKEFCCNGTVVQDPELGQVRYENNAFQACKNGICRLVDILICLSAAGHSAPR

SEQ ID NO: 697 - DNA, 1527 bp, Zea mays
  CDS (1)..(1527)
atgccttccgccggcgtcgccaccggccgtgctccctccctccggccccggttgaccctagcctcgcatcaccctaaccctacccccctcccgccgctgccagagcaggggaaaaagatgccgcgcgagatcatcacgatccaggtggggcaatgcgggaaccagatcgggatggagttctggaagcagctctgcctcgagcacggcatcggcaaggacggcctcctcgaggacttcgccactcaggggggcgacaggaaggatgtcttcttttaccaggctgatgatcagcacttcatacccaggtctctgcttattgacctggagccgagagtgatcaatgggattcagaacagcgagtacaggaacctgtacaaccatgagaacatatttgttgctgagcacggtggtggtgccgggaacaactgggccagtgggtatcatcagggtgaacaatttgttgatgatatcatggacatggttgacagagaagctgatggaagtgatagccttgagggttttgtcctgtgccactctattgctggtggaactggttcaggtatgggttcttatctattggagacactgaatgatcgatacagtaaaaagcttgtgcagacatatagtgttttcccaaatcaggtggaaacaagtgatgttgtcgtccaaccttacaactcacttttgactctgaagcggctgacactgaatgctgactgtgtggttgttcttgacaatacggctcttaataggattgccgtcgagcgccttcatctatcaaatcctacgtttgcacaaacaaactctttggtctccacggttatgtctgcaagcacaactactttaaggtatcctggatatatgaacaatgatctggttggccttcttgcctccttgattcccactccaaggtgtcattttttgatgacaggttatactccgttgactgtcgagcgccaggttaacatgatacgcaaaacgacggtattggatgttatgagaagacttctgcagacaaagaatataatggtgtcatcatatgctcgaacaaaagaagctagccaggctaaatacatctccatattgaacatcattcaaggggaggtggaccctacacaggttcacgagagcctgcaaagaatacgcgaaaggaagcttgttaactttatatactgggcacctgcaagcattcaggttgctttgtcaagaaaatccccttatgttcaaacaacccacagggttagtggtctgatgttagcaaatcatacaagcatccgtcatttattcagcaaatgcctgggacaatatgaaaagctaaggaaaaagcaggcttttcttgacaactacaggaagttcccaatgtttgcggacaatgatctatctgaatttgatgaatctcgagagataatagagagcctagttgatgaatacaaggcctgcgagtcgcctgactacatcaaatggggaatggaggaccctggagaggcaaatgttgtggcggcacttgactctaagttggtagtgtga

SEQ ID NO: 698 - protein, 508 aa, Zea mays
MPSAGVATGRAPSLRPRLTLASHHPNPTPLPPLPEQGKKMPREIITIQVGQCGNQIGMEFWKQLCLEHGIGKDGLLEDFATQGGDRKDVFFYQADDQHFIPRSLLIDLEPRVINGIQNSEYRNLYNHENIFVAEHGGGAGNNWASGYHQGEQFVDDIMDMVDREADGSDSLEGFVLCHSIAGGTGSGMGSYLLETLNDRYSKKLVQTYSVFPNQVETSDVVVQPYNSLLTLKRLTLNADCVVVLDNTALNRIAVERLHLSNPTFAQTNSLVSTVMSASTTTLRYPGYMNNDLVGLLASLIPTPRCHFLMTGYTPLTVERQVNMIRKTTVLDVMRRLLQTKNIMVSSYARTKEASQAKYISILNIIQGEVDPTQVHESLQRIRERKLVNFIYWAPASIQVALSRKSPYVQTTHRVSGLMLANHTSIRHLFSKCLGQYEKLRKKQAFLDNYRKFPMFADNDLSEFDESREIIESLVDEYKACESPDYIKWGMEDPGEANVVAALDSKLVV

SEQ ID NO: 699 - DNA, 507 bp, Zea mays
  CDS (1)..(507)
atggctgtcggaaagaacaagaggatctccaagggaaagaaggttgtattgaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttggggcatggattttaccactgataaactcagatccctagtgaagaagtggcagacattaatcgaagcccatgttgatgtcaagacaaccgacaactacatgttgcgtttgttctgcatcggcttcaccaagaggcgcccaaaccaagtccaaaaggaaggaatgtgccggctctcggtgtataaccctcccatcttgatgggttga

SEQ ID NO: 700 - protein, 168 aa, Zea mays
MAVGKNKRISKGKKVVLKKTVDPFSKKDWYDIKAPSVFSVRNIGKTLVSRTQGTRIASEGLKHRVFEVCLADLQGDEDQAYRKIRLRAEDVQGRNVLTNFWGMDFTTDKLRSLVKKWQTLIEAHVDVKTTDNYMLRLFCIGFTKRRPNQVQKEGMCRLSVYNPPILMG

SEQ ID NO: 701 - DNA, 723 bp, Zea mays
  CDS (1)..(723)
atgcccgagctccgaaggccgcagcatcaggcgcggcccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacgtggcatagggacctgtgcagggtctgtgaaaacatccccattgtcctctgcggtaataaggttgatgtgaagaacaggcaggtcaaagccaagcaggttactttccacaggaagaagaatctgcagtactatgaaatttctgccaagagcaactacaactttgagaaacctttcctgtacctcgcaaggaagctggctggtgatccgaaccttcactttgttgaagctgttgctcttaagcctccggaagttaccatcgacatggctatgcagcagcagcatgaagctgagcttgctgcagcagctgcacaacctcttcctgatgacgatgatgatctgattgagtga

SEQ ID NO: 702 - protein, 240 aa, Zea mays
MPELRRPQHQARPPSRVTEMALPNQGTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDPNLHFVEAVALKPPEVTIDMAMQQQHEAELAAAAAQPLPDDDDDLIE

SEQ ID NO: 703 - DNA, 462 bp, Zea mays
  CDS (1)..(462)
atgcgggttgccatggcggaccagctcaccgacgaacagatcgccgagttcaaggaggccttcagcctcttcgacaaggacggcgacggctgcatcaccaccaaggaacttggcactgtgatgcgctcattggggcagaaccctactgaggctgagcttcaggacatgatcaatgaggttgatgctgatggcaatggaaccatcgactttcctgagtttctcaacctgatggcacgcaagatgaaggacaccgactctgaggaggagctcaaggaggccttccgtgtgttcgacaaggaccagaacggcttcatctccgctgctgagcttcgccatgtcatgaccaacctaggcgagaagctgacggacgaggaggtggacgagatgatccgtgaagccgacgtggacggtgatggccagatcaactacgacgagttcgtgaaggtgatgatggccaagtga

SEQ ID NO: 704 - protein, 153 aa, Zea mays
MRVAMADQLTDEQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYDEFVKVMMAK

SEQ ID NO: 705 - DNA, 540 bp, Zea mays
  CDS (1)..(540)
atgttgctctgccagagtcccagccagcgctcctccgccatgatccaggcggtgatggtgatcagcacccaggccaagccccgccttctcaagttctacagtttccagccacccgagaagcatcaggacctcgtccgctgtgtcttccaattactctctgcaaggcccgagagcgcgagcaattttgtcaaggtggactccatctttggcccgggaacaaaaatggtctacaagcatttggccacactatactttgtttttgtctttgatagctctgagaacgagcttgccatgctcgacctcgtacaagtgtttgttgaaacattggacagatgcttcaagaatgtatgcgagcttgacatcgtatttaacttcaacaagctgcacaccattttggatgagatgatatcggggggacaggtgatcgaaacaagttcagaacagataatgaaatctgtggaagagattgaaaggctggagaaacaatcgaacacaaccagcttcatacccaagtcgattacagagcgttttacccgttga

SEQ ID NO: 706 - protein, 179 aa, Zea mays
MLLCQSPSQRSSAMIQAVMVISTQAKPRLLKFYSFQPPEKHQDLVRCVFQLLSARPESASNFVKVDSIFGPGTKMVYKHLATLYFVFVFDSSENELAMLDLVQVFVETLDRCFKNVCELDIVFNFNKLHTILDEMISGGQVIETSSEQIMKSVEEIERLEKQSNTTSFIPKSITERFTR

SEQ ID NO: 707 - DNA, 1452 bp, Zea mays
  CDS (1)..(1452)
atggcgtcttcgtactcgcctacctccgcggctcaaacctttcccccttctcccaattccttccgccggccgccgctccacccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtcccccgtgctgtttttgttgaccttgaacccactgtcatcgatgaggtgaggactggcacctaccgccagctcttccaccctgagcagctcatcagtggcaaggaggatgcagccaacaacttcgcccgtggtcactacaccattggcaaggagattgttgacctgtgccttgatcgcatcaggaagcttgccgacaactgcactggtctccagggcttcctcgtcttcaacgctgttggtggaggaacgggctctggccttggttccctcctcctagagcgcctgtctgttgactacggcaagaagtccaagcttggtttcactgtgtacccatccccccaagtttctacttcggtggttgagccatacaacagtgtcctgtccacccactccctcctcgagcacactgatgtggctatcctgctggacaatgaggccatctatgacatctgccgccgttcccttgacattgagcgcccaacctacaccaacctcaacaggcttgtgtcccaggtcatctcatccctgactgcctccctgaggttcgatggtgctcttaacgtggatgtgaatgagttccagaccaacttggtgccctacccgaggatccacttcatgctttcctcctatgctccagtcatctctgctgagaaggcctaccacgagcagctgtctgtggccgagatcaccaacagcgccttcgagccatcctccatgatggccaagtgcgatccccgccatggtaagtacatggcctgctgcctcatgtaccgtggtgatgtggtccccaaggatgtgaatgctgctgtggccaccatcaagaccaagcgcaccatccagtttgtggactggtgcccaactggctttaagtgcggcattaactaccagcctccaagtgtggtgcctggtggtgacctggccaaggtgcagcgcgctgtgtgcatgatctccaactccaccagtgttgtggaggtgttctcccgcatcgaccacaagttcgacctcatgtacgccaagcgtgccttcgtgcactggtatgtcggtgagggtatggaggagggcgagttctctgaggcccgtgaggatctggcagcgctcgagaaggactacgaggaggttggtgctgagtttgatgagggtgaggaaggtgatgatggtgatgagtactga

SEQ ID NO: 708 - protein, 483 aa, Zea mays
MASSYSPTSAAQTFPPSPNSFRRPPLHPYDDTMRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVAILLDNEAIYDICRRSLDIERPTYTNLNRLVSQVISSLTASLRFDGALNVDVNEFQTNLVPYPRIHFMLSSYAPVISAEKAYHEQLSVAEITNSAFEPSSMMAKCDPRHGKYMACCLMYRGDVVPKDVNAAVATIKTKRTIQFVDWCPTGFKCGINYQPPSVVPGGDLAKVQRAVCMISNSTSVVEVFSRIDHKFDLMYAKRAFVHWYVGEGMEEGEFSEAREDLAALEKDYEEVGAEFDEGEEGDDGDEY

SEQ ID NO: 709 - DNA, 318 bp, Zea mays; identical to SEQ ID NO: 579
  CDS (1)..(318)

SEQ ID NO: 710 - protein, 105 aa, Zea mays; identical to SEQ ID NO: 580

SEQ ID NO: 711 - DNA, 1659 bp, Zea mays
  CDS (1)..(1659)
atgtgcccccactccctgtctcgcgcggcggccatgggaaactgctgccgctcgccggccgccgcggcgcgggaagacgtcaagtcgtcgcacttcccggcctccgccggcgggaagaagaagccccaccagcaggcgcggaacggcggccccggctccggggagaagaagcgtctgtcggtgctcggggaggaggggtgcgacgtgggcgcgggcgggatcgagagagaagtacgcgctggaccgggagctggggcgcggcgagttcggggtgacgtacctgtgcatggaccggggcacgcgggagctgctcgcctgcaagtccatctccaagcgcaagctgcggacggccgtcgacgtggaggacgtgcgccgggagtggccatcatgcgccacctgcccaagagccccagcgtcgtgtccctgcgggaggcgtgcgaggacgagggcgccgtgcacctcgtcatggagctctgcgagggcggcgagctcttcgaccgcatcgtcgcgcgggggcactacaccgagcgcgccgccgccagtgtcacccgcaccatcgtcgaggtcgtccagctctgccaccgccacggcgtcatccaccgggacctcaagccggagaacttcctcttcgccaataagaaggagaactcgccgctcaaggccatcgacttcggtctctccatcttcttcaagcctggtgaaaagttttcagaaattgtgggaagtccctactacatggctcctgaagtcttgaagaggaactatggacctgaaatagacatatggagcgctggtgttatcttgtatattttgttatgtggcgttcctccgttttgggctgagactgaacaaggagttgcacaagctattctccggggaaatatagattttaagcgagaaccctggcccaatgtttctgacaatgctaaagatcttgttcggcagatgcttcaacctgatccaaaactcaggctaacagcaaagcaagttcttgagcatccctggcttcaaaatgctaagaaagctccaaatgttcctcttggagacattgtaaagtcaaggctgaaacagttttcaaggatgaacagattcaaaagaaaagctctaagggttattgctgatcacttgtcagctgaagaggttgaggacataaaggatatgttcaaggtgatggatactgataatgatggcatagtttcttatgaagagttaaagagtgggatcgcaaattttggttctcatcttgcagaatcagaagtgcaaatgcttatcgaagctgtggatacaaatggtagaggagcactagattacggtgaatttttggctgtctcgctccatttacaaaggatggcaaatgacgagcaccttcggcgggccttcctatttttcgacaaggatggcaacggtttcatcgagcccgaggagcttcaggaagccctgatggaggacgggggagctgataccatggacgtggtcaatgacatattgcaagaagttgacacagacaaggatgggaaaattagctacgacgaatttgtagcgatgatgaaaactggcacggactggaggaaggcatcgcggcactattcaagagggcgcttcaatagccttagcataaagcttataaaagacgggtctgtaaagctgggtagcgagtga

SEQ ID NO: 712 - protein, 552 aa, Zea mays
MCPHSLSRAAAMGNCCRSPAAAAREDVKSSHFPASAGGKKKPHQQARNGGPGSGEKKRLSVLGEEGCDVGAGGIEREVRAGPGAGARRVRGDVPVHGPGHAGAARLQVHLQAQAADGRRRGGRAPGVAIMRHLPKSPSVVSLREACEDEGAVHLVMELCEGGELFDRIVARGHYTERAAASVTRTIVEVVQLCHRHGVIHRDLKPENFLFANKKENSPLKAIDFGLSIFFKPGEKFSEIVGSPYYMAPEVLKRNYGPEIDIWSAGVILYILLCGVPPFWAETEQGVAQAILRGNIDFKREPWPNVSDNAKDLVRQMLQPDPKLRLTAKQVLEHPWLQNAKKAPNVPLGDIVKSRLKQFSRMNRFKRKALRVIADHLSAEEVEDIKDMFKVMDTDNDGIVSYEELKSGIANFGSHLAESEVQMLIEAVDTNGRGALDYGEFLAVSLHLQRMANDEHLRRAFLFFDKDGNGFIEPEELQEALMEDGGADTMDVVNDILQEVDTDKDGKISYDEFVAMMKTGTDWRKASRHYSRGRFNSLSIKLIKDGSVKLGSE

SEQ ID NO: 713 - DNA, 495 bp, Zea mays
  CDS (1)..(495)
atgccggcggggcacgggctgcggtcgcggacccgcgacctgttcgcgcggcccttccgcaagaaggggtacatcccgctcaccacgtacctgcgcacctacaagatcggcgactacgtcgacgtcaaggttaacggcgccgtgcacaagggcatgccgcacaagttctaccacggccgcaccgggagcgtctggaacgtcaccaagcgcgccatcggcgtcgagatcaacaagcaggttaatggccgcatcatcaggaagcggatccatgtccgcgtggagcatgtgcagccctcccgttgcacagaggagttccgcctgaggaaagccaagaatgaccagctcaaggcggatgccaaggcccgcggtgaggtgatcagcaccaagaggcagcctgtgggacccaaacctggcttcatggtcgagggtgctacactcgagacagtcactcctattccttatgatgtggtcaacgatctcaagggcggttactga

SEQ ID NO: 714 - protein, 164 aa, Zea mays; identical to SEQ ID NO: 306

SEQ ID NO: 715 - DNA, 1641 bp, Zea mays
  CDS (1)..(1641)
atgcccgcttccgcttcccctcagccgtcacctccccgctcccaccgccaccaatcgcactcgcagtggctgttggcgtgcgctcgcgtccaaaccaagcaaaccccacaaatcctaccttccgctggcgtcgccaccggccgtgctccctccctccggccccggttgaccctagcctcgcatcaccctaaccctacccccctcccgccgctgccagagcaggggaaaaagatgccgcgcgagatcatcacgatccaggtggggcaatgcgggaaccagatcgggatggagttctggaagcagctctgcctcgagcacggcatcggcaaggacggcctcctcgaggacttcgccactcaggggggcgacaggaaggatgtcttcttttaccaggctgatgatcagcacttcatacccaggtctctgcttattgacctggagccgagagtgatcaatgggattcagaacagcgagtacaggaacctgtacaaccatgagaacatatttgttgctgagcacggtggtggtgccgggaacaactgggccagtgggtatcatcagggtgaacaatttgttgatgatatcatggacatggttgacagagaagctgatggaagtgatagccttgagggttttgtcctgtgccactctattgctggtggaactggttcaggtatgggttcttatctattggagacactgaatgatcgatacagtaaaaagcttgtgcagacatatagtgttttcccaaatcaggtggaaacaagtgatgttgtcgtccaaccttacaactcacttttgactctgaagcggctgacactgaatgctgactgtgtggttgttcttgacaatacggctcttaataggattgccgtcgagcgccttcatctatcaaatcctacgtttgcacaaacaaactctttggtctccacggttatgtctgcaagcacaactactttaaggtatcctggatatatgaacaatgatctggttggccttcttgcctccttgattcccactccaaggtgtcattttttgatgacaggttatactccgttgactgtcgagcgccaggttaacatgatacgcaaaacgacggtattggatgttatgagaagacttctgcagacaaagaatataatggtgtcatcatatgctcgaacaaaagaagctagccaggctaaatacatctccatattgaacatcattcaaggggaggtggaccctacacaggttcacgagagcctgcaaagaatacgcgaaaggaagcttgttaactttatagactgggcacctgcaagcattcaggttgctttgtcaagaaaatccccttatgttcaaacaacccacagggttagtggtctgatgttagcaaatcatacaagcatccgtcatttattcagcaaatgcctgggacaatatgaaaagctaaggaaaaagcaggcttttcttgacaactacaggaagttcccaatgtttgcggacaatgatctatctgaatttgatgaatctcgagagataatagagagcctagttgatgaatacaaggcctgcgagtcgcctgactacatcaaatggggaatggaggaccctggagaggcaaatgttgtggcggcacttgactctaagttggtagtgtga

SEQ ID NO: 716 - protein, 546 aa, Zea mays
MPASASPQPSPPRSHRHQSHSQWLLACARVQTKQTPQILPSAGVATGRAPSLRPRLTLASHHPNPTPLPPLPEQGKKMPREIITIQVGQCGNQIGMEFWKQLCLEHGIGKDGLLEDFATQGGDRKDVFFYQADDQHFIPRSLLIDLEPRVINGIQNSEYRNLYNHENIFVAEHGGGAGNNWASGYHQGEQFVDDIMDMVDREADGSDSLEGFVLCHSIAGGTGSGMGSYLLETLNDRYSKKLVQTYSVFPNQVETSDVVVQPYNSLLTLKRLTLNADCVVVLDNTALNRIAVERLHLSNPTFAQTNSLVSTVMSASTTTLRYPGYMNNDLVGLLASLIPTPRCHFLMTGYTPLTVERQVNMIRKTTVLDVMRRLLQTKNIMVSSYARTKEASQAKYISILNIIQGEVDPTQVHESLQRIRERKLVNFIDWAPASIQVALSRKSPYVQTTHRVSGLMLANHTSIRHLFSKCLGQYEKLRKKQAFLDNYRKFPMFADNDLSEFDESREIIESLVDEYKACESPDYIKWGMEDPGEANVVAALDSKLVV

SEQ ID NO: 717 - DNA, 384 bp, Zea mays
  CDS (1)..(384)
atgggggtggctgcggcagctgccgcgttcatcgccctcgtggcgttcggatccgcctcatcctcgcccaagtccttcgtgaagtccaccgtctccgcccacgacgtcgtcatcttctccaagtcatactgcccgtactgcaaaagagcaaaggccgtgtttaaggagcttgagttgaagaaagagccatatgttgtggagcttgatcagcgagaggatggctcagagattcaggatgccttacttgagatagttggcaggcgtactgtccctcaagtttttgtccatggaaagcacctgggtggttctgacgatactgttgactcctacgaaagtggaaaactggctagacttctaaacatcggagtcaaggacgacctttga

SEQ ID NO: 718 - protein, 127 aa, Zea mays
MGVAAAAAAFIALVAFGSASSSPKSFVKSTVSAHDVVIFSKSYCPYCKRAKAVFKELELKKEPYVVELDQREDGSEIQDALLEIVGRRTVPQVFVHGKHLGGSDDTVDSYESGKLARLLNIGVKDDL

SEQ ID NO: 719 - DNA, 816 bp, Zea mays
  CDS (1)..(816)
atggcgggcacgaggcaacgctctctgccgtccgagaccccaagcaccagcgcggcggcgggggcggcggcgaccatggctgtcggaaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgacgaggatcaagcttacaggaaaatcaggctccgtgctgaagatgtgcagggcaggaatgtgctcacaaacttttggggcatgaattttaccactgataaactcagatccctagtgaagaagtggcagacattaatcgaagcccatgttgatgtcaagacaaccgacaactacatgttgcgtttgttctgcatcggcttcaccaagaggcgcccaaaccaagtcaagagaacctgctatgctcaggcatcccagatccgtcagatccgccgaaagatggttgagattatgatcaaccaggcttctacatgtgacctgaaagaacttgtttcgaagttcattccagaagttattggtaaagagattgagaagtctacctccagcatcttcccacttcaaaacgtcttcatccgcaaggtgaagatactcaaggcccccaagttcgatcttgggaaactcatggaggttcatggcgactacaaagaggatgttggtgtgaagcttgagaggccttga

SEQ ID NO: 720 - protein, 271 aa, Zea mays
MAGTRQRSLPSETPSTSAAAGAAATMAVGKNKRISKGKKGGKKKTVDPFSKKDWYDIKAPSVFSVRNIGKTLVSRTQGTRIASEGLKHRVFEVCLADLQGDEDQAYRKIRLRAEDVQGRNVLTNFWGMNFTTDKLRSLVKKWQTLIEAHVDVKTTDNYMLRLFCIGFTKRRPNQVKRTCYAQASQIRQIRRKMVEIMINQASTCDLKELVSKFIPEVIGKEIEKSTSSIFPLQNVFIRKVKILKAPKFDLGKLMEVHGDYKEDVGVKLERP

SEQ ID NO: 721 - DNA, 1413 bp, Zea mays
  CDS (1)..(1413)
atgcacgagggttcactgagcacgttacgttgtaatggtgaaattagcagatttgcaagccctggcgtcgagttgatgaggtccatgttctctactgtagtgactgatccgatcaaagatattggaagaggtggtccaatggtggaatatgagaggagaatagcatcaggagagctagtagacggtgatagctttcaggttgatacaattcaacaattacaaaggctctatgaggagttgattgagaatgaagaagactgtcagctggatagatataaatcatctgagaaatcaggccggagtcgatggctatggtcccgcctcattactcagccttctacgtatgctcctattaagggcctttacctctatggtggtgttggtacagggaagacaatgcttatggacttgttctatgaacagctgccatttaattggagaaaaaaacgtattcactttcatgatttcatgctgaatgtacatagtcgtcttcagatgcacaaaggtgtttcagatccccttgatgttgtagcagctgagatttcagatgaggccatcatattatgtcttgatgagtttatggtaactgatgttgctgatgctatgattctgaaccgtctgttcagacaattgttcagcaaaggcgttattcttgtttcgacttctaaccgtgctccagataagctttatgaaggtggcttacaacgggaccttttcttgccatttattgacaccttgaaagaaagatgcatcgtgcatgccattggatctgcggtggactatcgtcaactgggttctgctgaacaaggtttctattttgtcggaaagcattacagtacgcttctgaaacagaagctccagtctttaattggagatgaggaacccagcccacaaactgttgaagtaattatgggaaggaaattacaggtttctctgggagcaaatggctgtgcatattttccttttgaagatctctgtgatagacctttaggtgcagcagattactttggactcttcaaaaaatttcacaccctggcacttgatggtgttccaaagtttgggtctagtaacagaacagcagcttatcggttcgtcacactgattgatgttatgtacgagaacaaagcaaggctgttatgtacagccgaggctggaccagtagaactgtttgagaatatcatgactcttgctgaagcacagaaggtttcaccaagatcttcgcgctcacagaaaagtgacgaccctgacctatgtgtggacaatgagcttggatttgccaaggatcgtacgattagcaggttgacagagatcaacagcagagaatatttggaggacttcgaaatgagattagggcaacagcagctgctgcccttgcaagctctagataatggtggtgatgttgtactagcatga

SEQ ID NO: 722 - protein, 470 aa, Zea mays
MHEGSLSTLRCNGEISRFASPGVELMRSMFSTVVTDPIKDIGRGGPMVEYERRIASGELVDGDSFQVDTIQQLQRLYEELIENEEDCQLDRYKSSEKSGRSRWLWSRLITQPSTYAPIKGLYLYGGVGTGKTMLMDLFYEQLPFNWRKKRIHFHDFMLNVHSRLQMHKGVSDPLDVVAAEISDEAIILCLDEFMVTDVADAMILNRLFRQLFSKGVILVSTSNRAPDKLYEGGLQRDLFLPFIDTLKERCIVHAIGSAVDYRQLGSAEQGFYFVGKHYSTLLKQKLQSLIGDEEPSPQTVEVIMGRKLQVSLGANGCAYFPFEDLCDRPLGAADYFGLFKKFHTLALDGVPKFGSSNRTAAYRFVTLIDVMYENKARLLCTAEAGPVELFENIMTLAEAQKVSPRSSRSQKSDDPDLCVDNELGFAKDRTISRLTEINSREYLEDFEMRLGQQQLLPLQALDNGGDVVLA

SEQ ID NO: 723 - DNA, 543 bp, Zea mays
  CDS (1)..(543)
atgccggcgaagccgcaaagcgcccggaactcccgtgatggcgatggccatctccggcttgtgattatcgtccttgtaggtggaaggccgcagcgcgtgcagcacctcggcgagtttcttgtccgggtgcgcctggatcgagagcgccttggccaccgacaggaccttgaagaggaatgggaggtcgactccccagcgcgcagcgacggcggggccgagcgcgtcggggttccgcgcgagccagtcactgaggagcgtaccgtcgtcgaggagcgtggagggggcagacgggtgagtgcccatccagagctcggcataggggcgggccgggtcggggttctggtcggcgaggcgcgcgacgagggaggcggctccgcgctggccccactcgtagtgctgcaccgcgcagcgcaatcgcagcagcctttgcggaggcgcaggggaggcctcgggatcgggatcgggctcggactccggctcaggcagaggaagcgctggtgggtcctccattgggcgggacttgaactgggattgaggacctga

SEQ ID NO: 724 - protein, 180 aa, Zea mays
MPAKPQSARNSRDGDGHLRLVIIVLVGGRPQRVQHLGEFLVRVRLDRERLGHRQDLEEEWEVDSPARSDGGAERVGVPREPVTEERTVVEERGGGRRVSAHPELGIGAGRVGVLVGEARDEGGGSALAPLVVLHRAAQSQQPLRRRRGGLGIGIGLGLRLRQRKRWWVLHWAGLELGLRT

SEQ ID NO: 725 - DNA, 387 bp, Zea mays
  CDS (1)..(387)
atgagtacaacatgccacctgcagcagcgaaaagttaataaaaagggaaaaggaggaaagaagaagaccactgactctttcgcaagaaaggattggtatgatatcaaagcaccaagaatgtttaacaccactaatgctggtaaaaccattgttaaccgtactaccggaaacaaaatcgcttctgataacttgaaaggtcgtgttgtcactcttaacttagctgatttacaacaaaacgagaaatacgcacacaccaacgtcaaattgagagtcgaagaagttcaaggaaaacactgcttaaccaacttctacggtctttcttacactactgataaagttaaatccttagttaagaaatggcaaagtctcattgaagtcagtgtttga

SEQ ID NO: 726 - protein, 128 aa, Zea mays
MSTTCHLQQRKVNKKGKGGKKKTTDSFARKDWYDIKAPRMFNTTNAGKTIVNRTTGNKIASDNLKGRVVTLNLADLQQNEKYAHTNVKLRVEEVQGKHCLTNFYGLSYTTDKVKSLVKKWQSLIEVSV

SEQ ID NO: 727 - DNA, 624 bp, Zea mays
  CDS (1)..(624)
atgaagagtagatctacatctactccaccgatgagcgcgtctcggttcatcaagtgcgtcaccgtgggggacggtgccgtcggaaagacctgcatgctcatctcctacacatccaacactttccccactgactatgttccaactgtgttcgacaacttcagtgccaatgttgtggttgacgggagcactgtcaacttgggtctgtgggatacagcaggacaagaagattacaatagactgcgtccgttgagctatcgtggtgctgatgtttttctgctcgccttttctcttatcagcaaagcaagctatgagaatgtctctaagaagtgggttcctgaattaaggcactatgctcctggcgtgcccataatccttgttgggacaaaacttgatctgcgtgatgataagcagttttttgttgatcaccctggtgctgttccaatttccactgcccagggcgaagagctgaggaagctaattggtgctgccgcctacatcgaatgcagttcaaaaacccagcagaacataaaagcagtgtttgacgcagcaattaaggtggttctccagccaccaaagcaaaagaagaggaagaagaaggtgcagaagggatgcaccattttgtga

SEQ ID NO: 728 - protein, 207 aa, Zea mays
MKSRSTSTPPMSASRFIKCVTVGDGAVGKTCMLISYTSNTFPTDYVPTVFDNFSANVVVDGSTVNLGLWDTAGQEDYNRLRPLSYRGADVFLLAFSLISKASYENVSKKWVPELRHYAPGVPIILVGTKLDLRDDKQFFVDHPGAVPISTAQGEELRKLIGAAAYIECSSKTQQNIKAVFDAAIKVVLQPPKQKKRKKKVQKGCTIL

SEQ ID NO: 729 - DNA, 552 bp, Zea mays
  CDS (1)..(552)
atgccacccactcgcttcagccgcctccgccgcgcgtaccaagcaggtggagacaggatgccggctggccacggcctgcgctcgcggacgcgcgacctcttcgcgcgccccttccgcaagaagggctacatcccgctcaccacctacctccgcacctacaagatcggcgattacgtcgatgtcaaggtgaacggcgccgtccacaaggggatgccgcacaagttctaccacggccgcaccggtcgcgtctggaacgtcaccaagcgcgccatcggcgtcgaggtcaacaagcaggtcaatgggcgcatcatcaggaagcgtatccatgtccgtgtggagcatgtgcagccgtcccgctgcacagaagagttccgcctgaggaaggcgaagaatgaccagctgaaggcggatgccaaaaagcgcggcgaggttatcagcaccaagaggcagccattgggtcccaagcccggcttcatggtcgagggcaccaccattgagaccgtaactcccatcccatatgatgtggtcaatgatctcaagggtggatactga

SEQ ID NO: 730 - protein, 183 aa, Zea mays
MPPTRFSRLRRAYQAGGDRMPAGHGLRSRTRDLFARPFRKKGYIPLTTYLRTYKIGDYVDVKVNGAVHKGMPHKFYHGRTGRVWNVTKRAIGVEVNKQVNGRIIRKRIHVRVEHVQPSRCTEEFRLRKAKNDQLKADAKKRGEVISTKRQPLGPKPGFMVEGTTIETVTPIPYDVVNDLKGGY

SEQ ID NO: 731 - DNA, 381 bp, Zea mays
  CDS (1)..(381)
atgatgaccgaatccccacggaggaacatcttgcttatgaacctgtccttgttcaccgggagagccttcttcttgcctttaccggtcttcggtacctcggtccacatctccctaacgttctcaagaaccatgttgcagtgccgatcgaaggctcgcacgcgaccaagcaacttcttgttgttccggcagttgataagaacctgggtattattcttgacgctcatcatgagcaccgagagaggaccggtgctgaactcctcttcctccttttttatgttggtttcttccgccatgggcgccaattggagccgtcaatctgggtggcagcggcgagacggcggcggcgcgtcgagagggatgaactgtagggttttttcctga

SEQ ID NO: 732 - protein, 126 aa, Zea mays
MMTESPRRNILLMNLSLFTGRAFFLPLPVFGTSVHISLTFSRTMLQCRSKARTRPSNFLLFRQLIRTWVLFLTLIMSTERGPVLNSSSSFFMLVSSAMGANWSRQSGWQRRDGGGASRGMNCRVFS

SEQ ID NO: 733 - DNA, 897 bp, Zea mays
  CDS (1)..(897): n means a or g or c or t/u
atgnnggtcgacttcgctgtcgacgatttcgtggcggacgcgaagcagcagcagcagcagcagcagcagcagccacagcaggcggcagcggcagccaccggcgtgtggaagacggtcaagcccttcgttaacggcggggcctctgggatgctcgcgacctgcgtcatccagcctatcgacatggtcaaggtgaggatccagttgggtgagggctctgctggtcaggtcacaaggaacatgcttgcaaatgagggtgtccgttctttctacaagggtttgtccgccggattgctgaggcaagcgacgtacacgactgctcgtcttggatcctttagggttctaactaacaaagcagttgaaaagaatgaagggaagccattgcctctatttcagaaagcttttattggtctgactgctggtgcaattggtgcttgtgttggtagtcctgctgatctggcactcattagaatgcaagccgattcgaccctgccagttgcacaacgacgcaactataagaatgctttccatgcactctaccgtatcagtggtgatgagggagtccttgcgctttggaagggtgcaggtccaactgtggtgagagctatggcactcaatatgggtatgcttgcttcctatgaccagagtgtcgagctatttagggacaaatttggcgcaggagaaatttctactgttgttggagccagcgctgtttctggattctttgcctcagcatgcagtttgccctttgactatgtgaagacacagattcagaagatgcaacctgatgcgaatggcaagtacccatacacagggtctttggactgtgctgtgaagaccttncagagcggtggcccatttcagttctacactggtttcccggtgtactgcgtcaggtga

SEQ ID NO: 734 - protein, 298 aa, Zea mays
  misc_feature (2)..(2): Xaa can be any amino acid
  misc_feature (280)..(280): Xaa can be Leu or Phe
MXVDFAVDDFVADAKQQQQQQQQQPQQAAAAATGVWKTVKPFVNGGASGMLATCVIQPIDMVKVRIQLGEGSAGQVTRNMLANEGVRSFYKGLSAGLLRQATYTTARLGSFRVLTNKAVEKNEGKPLPLFQKAFIGLTAGAIGACVGSPADLALIRMQADSTLPVAQRRNYKNAFHALYRISGDEGVLALWKGAGPTVVRAMALNMGMLASYDQSVELFRDKFGAGEISTVVGASAVSGFFASACSLPFDYVKTQIQKMQPDANGKYPYTGSLDCAVKTXQSGGPFQFYTGFPVYCVR

SEQ ID NO: 735 - DNA, 729 bp, Zea mays; identical to SEQ ID NO: 253
  CDS (1)..(729): n means a or g or c or t/u

SEQ ID NO: 736 - protein, 242 aa, Zea mays; identical to SEQ ID NO: 254
  misc_feature (3)..(3): Xaa can be Lys or Thr or Arg or Met
  misc_feature (210)..(210): Xaa can be Ala or Glu or Gly or Val
  misc_feature (214)..(214): Xaa can be Asp or Glu
  misc_feature (233)..(233): Xaa can be Ala or Glu or Gly or Val

SEQ ID NO: 737 - DNA, 378 bp, Zea mays; identical to SEQ ID NO: 335
  CDS (1)..(378)

SEQ ID NO: 738 - protein, 125 aa, Zea mays; identical to SEQ ID NO: 336

SEQ ID NO: 739 - DNA, 348 bp, Zea mays
  CDS (1)..(348)
atgctgaggacgatgatgaccgaatccccgcggaggaacatcttgcttatgaacctgtccttgttcaccgggagagccttcttcttgcctttaccggtcttcggtacctcggtccacatctcacgaacattctcaagaaccatgttgcagtgccgatcgaaggctcgcacgcgaccaagcaacttcttgttgttccggcagttgataagaacctgggtattattcttgacgctcatcatgagcaccgagagaggaccggtgctgaactcctcttcctccttttttatgttggtttcttccgcccatgggcgccaattggagccgtcaatctgggtgggcagcggctga

SEQ ID NO: 740 - protein, 115 aa, Zea mays
MLRTMMTESPRRNILLMNLSLFTGRAFFLPLPVFGTSVHISRTFSRTMLQCRSKARTRPSNFLLFRQLIRTWVLFLTLIMSTERGPVLNSSSSFFMLVSSAHGRQLEPSIWVGSG

SEQ ID NO: 741 - DNA, 717 bp, Zea mays
  CDS (1)..(717): n means a or g or c or t/u
atgcttctcgtagaagataagcaaagcaaggcaaccgttgtcgttgtctctgttcctccgcttcctgctctcttggcttgctgcttgccctcggagcagtgccttccgccgccgccgccgccgcctgttgtgagaaggagaggccggggctgggaggagatgagcgtgaccaagttcatcaagtgcgtcacggtgggggacggcgcggtgggcaagacctgcatgctcatctgctacaccagcaacaagttccccacggattacatccccacggtgttcgacaacttcagcgccaacgtctccgtggacggcagcatcgtcaacctgggcctctgggacactgcaggacaagaggactacagcagattgcggccactgagctacaggggcgcggacgtgttcgtgctggccttctccttgatcagcagggcgagctatgagaacgtccttaagaagtgggtgccagagcttcgcagattcgcgcccgacgtcccggtcgttcttgtcgggaccaagttagatctccgtgaccacagggcctaccttgctgaccatcctggagcgtcgacgatcacgacggcacagggcgaagaactgaggaggcagatcggcgctgcggcttacatcgagtgcagttccaaaacgcagcagaatgtcaagtcggtcttcgacacagccatcaaagtggtcttcagcccccgcggaaganggaggtga

SEQ ID NO: 742 - protein, 238 aa, Zea mays
  misc_feature (237)..(237): Xaa can be Arg or Gly or Trp
MLLVEDKQSKATVVVVSVPPLPALLACCLPSEQCLPPPPPPPVVRRRGRGWEEMSVTKFIKCVTVGDGAVGKTCMLICYTSNKFPTDYIPTVFDNFSANVSVDGSIVNLGLWDTAGQEDYSRLRPLSYRGADVFVLAFSLISRASYENVLKKWVPELRRFAPDVPVVLVGTKLDLRDHRAYLADHPGASTITTAQGEELRRQIGAAAYIECSSKTQQNVKSVFDTAIKVVFSPRGRXR

SEQ ID NO: 743 - DNA, 477 bp, Zea mays
  CDS (1)..(477)
atgcctcttcggtcaaaaatatccttgtacctgcatctcgacctcaccggcgtccggcggtggtatcacgatggtggcgttgctgggccggcggatcggggtggctgcggcagtgccgcgttcatcgccctcgtggcgttcggatccgcctcatcctcgcccaagtccttcgtgaagtccaccgtctccgcccacgacgtcgtcatcttctccaagtcatactgcccgtactgcaaaagagcaaaggccgtgtttaaggagcttgagttgaagaaagagccatatgttgtggagcttgatcagcgagaggatggctcagagattcaggatgccttacttgagatagttggcaggcgtactgtccctcaagtttttgtccatggaaagcacctgggtggttctgacgatactgttgactcctacgaaagtggaaaactggctagacttctaaacatcggagtcaaggacgacctttga

SEQ ID NO: 744 - protein, 158 aa, Zea mays
MPLRSKISLYLHLDLTGVRRWYHDGGVAGPADRGGCGSAAFIALVAFGSASSSPKSFVKSTVSAHDVVIFSKSYCPYCKRAKAVFKELELKKEPYVVELDQREDGSEIQDALLEIVGRRTVPQVFVHGKHLGGSDDTVDSYESGKLARLLNIGVKDDL

SEQ ID NO: 745 - DNA, 1305 bp, Zea mays
  CDS (1)..(1305)
atgccacgcgtccgcaaccatcctccctccacagatctctccggggaggcagcaacagttatgtcatatcattgtcgcgtcctcgtccccgttccatttcattatccccccggagctggtgcgcgagtcggagctggtgcagggtcacccttcccctcggcctcaagagctctgcggttgccgcggccaagggcgtccgtggagaagcgggagcaggtggcggcgatggaagagcaaggcggccaggcggcgctcgggtgggcggccagggacgactccggcgtcctctccccctacagcttctccagaagggttcctaaagacgacgatgtcacgatcaaggtgctctactgcgggatctgccacaccgacctgcacgtcatcaagaacgactggcgaaacgccatgtacccagtcgtcccggggcacgagatcgtgggcgtggtgaccggcgtcggcggcggcgtcacgcggttcaaggccggcgacacggtcggcgtgggctacttcgtggggtcctgccgctcctgcgacagctgcggcaagggggacgacaactactgcgcggggatcgtgctcacctccaacggcgtcgaccacgcgcacggcggcgcgcccaccagggggggattctccgacgtcctggtcgcgagcgagcactacgtggtccgcgtccccgacggcctggcgctggaccgcaccgcgccgctgctctgcgccggcgtcaccgtgtacagccccatgatgcgccacggcctcaacgagcccggcaagcacctcggcgtcgtcggcctcggcggcctcggccacgtcgccgtcaagttcggcaaggccttcgggatgaaggtcaccgtcatcagcacgtccgccagcaagcgccaggaggccatcgagaacctcggcgcggacgagttcctcatcagccgggacgaggaccagatgaaggcggcgacggggaccatggacggcatcatcgacacggtgtcggcgtggcacccgatcacgccgctgctggcgctgctgaagccgctggggcagatggtggtcgtgggcgcgccgagcaagccgctcgagctgccggcctacgccatcgtgccgggcgggaagggcgtggctgggaacaatgtcggcagcgtcagggactgccaggccatgctcgagttcgcggggaagcacggcatcggggccgaggtcgaggtcatcaagatggactacgtcaacacggccatggagcggctcgagaagaacgacgtccgctaccgcttcgtcatcgacgtcgccggcagcctcggctctgccgcctga

SEQ ID NO: 746 - protein, 434 aa, Zea mays
MPRVRNHPPSTDLSGEAATVMSYHCRVLVPVPFHYPPGAGARVGAGAGSPFPSASRALRLPRPRASVEKREQVAAMEEQGGQAALGWAARDDSGVLSPYSFSRRVPKDDDVTIKVLYCGICHTDLHVIKNDWRNAMYPVVPGHEIVGVVTGVGGGVTRFKAGDTVGVGYFVGSCRSCDSCGKGDDNYCAGIVLTSNGVDHAHGGAPTRGGFSDVLVASEHYVVRVPDGLALDRTAPLLCAGVTVYSPMMRHGLNEPGKHLGVVGLGGLGHVAVKFGKAFGMKVTVISTSASKRQEAIENLGADEFLISRDEDQMKAATGTMDGIIDTVSAWHPITPLLALLKPLGQMVVVGAPSKPLELPAYAIVPGGKGVAGNNVGSVRDCQAMLEFAGKHGIGAEVEVIKMDYVNTAMERLEKNDVRYRFVIDVAGSLGSAA

SEQ ID NO: 747 - DNA, 681 bp, Zea mays
  CDS (1)..(681)
atgttcgatcaggtcatcatcgtcatcagggaggggttgcgcagcggcagctgcaagctcagcttcatgctgctgctgcatggccatatcaatctgcacttccggtggcttcagagcaacggcttcgacaaagtgaaggttctgatcccctgccagcttccttgcgaggtaaaggaagggcttctcaaagttgtaattgctcttggcagaaatctcatagtactgcaagttcttcttcctgtggaatgtaacttgcttggctttgacctgcctgttctttacatcaaccttgtttccgcagagaacgatggggatgttctcacacaccctgcacaggtccctgtgccatgttggaacattcttgtatgtcagcctcgaagtgacatcaaacataatgatggcacactgaccatgaatgtagtagccatccctgaggccaccgaacttttcttgcccagcagtgtcccagcaatagaaacgaattttgccacagttagtgctaaaatcgagagggtgaacttcaacaccaatggtgggctcatatttcttctcaaactcgccagtaagatgcctcttcacaaatgtggttttgccagttccaccgtcgccaacgatgacgagcttgaagctggggtaatccacaacctgctgattcggcagcgccatttctgcggcgggtga

SEQ ID NO: 748 - protein, 226 aa, Zea mays
MFDQVIIVIREGLRSGSCKLSFMLLLHGHINLHFRWLQSNGFDKVKVLIPCQLPCEVKEGLLKVVIALGRNLIVLQVLLPVECNLLGFDLPVLYINLVSAENDGDVLTHPAQVPVPCWNILVCQPRSDIKHNDGTLTMNVVAIPEATELFLPSSVPAIETNFATVSAKIERVNFNTNGGLIFLLKLASKMPLHKCGFASSTVANDDELEAGVIHNLLIRQRHFCGG

SEQ ID NO: 749 - DNA, 618 bp, Zea mays
  CDS (1)..(618)
atgtaccccgggtccccaccacacgcacgcgagcccgcggccaccacctcgatgccactgacgggctggaatccgctggcgcccgtccttcagaccgtcgccgctttctcccgccacatcctcatcgcccccgacgccgggctcgacgaccaccgcctccgcccccttctagcgctctccctctccccgcctttgccggcaccaccgcaaccggaggtccggaaggagaagaaggatgccaaggaggcgccactgacgaaggaggaggtcggccgggccacgtggatgctgcttcacaccatcgcagcgcagttccctgacgaacctacgaagcaacaaagacgcgatgcaaaggagttgatgcatataatctcgagactatatccttgcaaagaatgtgctgatcacttcaaggaagttttgaaagcaaatcctgtgcaggcaggatctcaggctgatttctcccagtggttatgttatgtccataacgtggttaatcgaagccttgggaagccaatatttccctgccaaagagtaactgcacgttggggtaaactggattgtcctgagcgctcgtgtgatctagaaggcagcatcgacatcatgccaaaccgatga

SEQ ID NO: 750 - protein, 205 aa, Zea mays
MYPGSPPHAREPAATTSMPLTGWNPLAPVLQTVAAFSRHILIAPDAGLDDHRLRPLLALSLSPPLPAPPQPEVRKEKKDAKEAPLTKEEVGRATWMLLHTIAAQFPDEPTKQQRRDAKELMHIISRLYPCKECADHFKEVLKANPVQAGSQADFSQWLCYVHNVVNRSLGKPIFPCQRVTARWGKLDCPERSCDLEGSIDIMPNR

SEQ ID NO: 751 - DNA, 741 bp, Zea mays
  CDS (1)..(741): n means a or g or c or t/u
atgatcccgatggcctcgcgccgccgcaccctgctcaaggtcatcatcctcggcgacagcggggttgggaagacgtctttgatgaaccaatatgtgaacaagaagttcagcaaccagtacaaggctacgattggggcggatttcctcaccaaggaggtgcagttcgaggacaggctcttcactctgcaaatatgggacactgctggtcaggaaaggtttcagagtcttggcgttgcattctaccggggagcagattgttgtgtcctagtctatgatgttaattctatgaaatcgtttgataatcttcacaactggcgtgaagagtttctaattcaggcgagcccatcagatcctgacaatttcccttttgttctgttgggtaacaaagttgatgtagatggtgggaacagccgtgtggtgtcggagaaaaaggcaaaggcatggtgcgcctctaaagggaacatcccgtactttgagacgtctgctaaggatggaacgaacgtggaagatgccttccagtgtattgtaaagaatgctctgaagaatgaaccggaggaagaattgtatgtgccagataccgtggatgtggtaggtggcaaccgggcccnagagatcatctggctgctgttaagacatgnaggcatccacganggcgtggtgatcatcatcggctatgcagtgatcaaacaatacctccttaacattgctgnggcctccatggttatctacgtgtccgtatga

SEQ ID NO: 752 - protein, 246 aa, Zea mays
  misc_feature (203)..(203): Xaa can be Arg or Gln or Leu or Pro
  misc_feature (213)..(213): Xaa can be Ala or Glu or Gly or Val
  misc_feature (217)..(217): Xaa can be Asp or Glu
  misc_feature (237)..(237): Xaa can be Ala or Glu or Gly or Val
MIPMASRRRTLLKVIILGDSGVGKTSLMNQYVNKKFSNQYKATIGADFLTKEVQFEDRLFTLQIWDTAGQERFQSLGVAFYRGADCCVLVYDVNSMKSFDNLHNWREEFLIQASPSDPDNFPFVLLGNKVDVDGGNSRVVSEKKAKAWCASKGNIPYFETSAKDGTNVEDAFQCIVKNALKNEPEEELYVPDTVDVVGGNRAXEIIWLLLRHXGIHXGVVIIIGYAVIKQYLLNIAXASMVIYVSV

SEQ ID NO: 753 - DNA, 666 bp, Zea mays
  CDS (1)..(666)
atgagcgaggtgttcgagggctacgagcggcagtactgcgaggcctccgcctcgctctcccgcaagtgcaccgctgcctccgccctcgatggggagaagaagaagcagaagctgtccgagatccaatccggcgttgaggaagctgaatcgctgattcgtaagatggacctggaggcaaggagcctacagcctagcattaaggctggtttgcttgcaaagctgagggagtataaatctgacctcaacaacgtcaagagtgagcttaagaggatctcagcgcccaatgctaggcaggctacccgggaggagctcctggagtctggaatggctgatactctcgcggtgtctactgatcagagggggagattgatgatgacaactgaaagactgaatcagtcaactgacagaattaaagagagccgaagaactatgttggagacagaagagcttggtgtgtcaattcttcaggaccttcaccaacagcgacagtcactactacatgctcatactactttgcacggagttgatgacaacattggcaagagcaagaagatcctggctgcaatgtcaaagaggatggataggaacaagtggatcattgggggaattatcacggctctcgttctggccatccttctcatactctacttcaagctcgctaattga

SEQ ID NO: 754 - protein, 221 aa, Zea mays
MSEVFEGYERQYCEASASLSRKCTAASALDGEKKKQKLSEIQSGVEEAESLIRKMDLEARSLQPSIKAGLLAKLREYKSDLNNVKSELKRISAPNARQATREELLESGMADTLAVSTDQRGRLMMTTERLNQSTDRIKESRRTMLETEELGVSILQDLHQQRQSLLHAHTTLHGVDDNIGKSKKILAAMSKRMDRNKWIIGGIITALVLAILLILYFKLAN

SEQ ID NO: 755 - DNA, 645 bp, Zea mays
  CDS (1)..(645)
atggcgtccagcgcctctcggttcatcaagtgcgtcacggtcggcgacggtgccgtgggcaagacatgtatgctcatctgctacaccagcaacaagttccccactgactacatacctacggtgttcgacaatttcagtgcaaatgtagttgtggatggcaccactgtgaatttgggcctttgggataccgctgggcaggaagattacaaccgcctgaggcctctaagctaccgaggtgcagatgttttcgtgcttgcattctcacttgtgagccgagctagctatgagaatatcatgaagaagtggataccagagcttcaacattatgcacctggggtgcccgttgttttggcaggcacaaaattggatcttcgtgaagacaagcactacttgatggaccatcctggattggtgcctgttaccactgcacagggggaggaacttcgtagacaaattggtgctatgtattacattgaatgcagctcaaagacacagcagaatgtcaaagctgtgttcgatgctgccatcaaggtagtaatccagcctccaactaaaataagagaaaagaagaagaaaaaatcacgcaaaggatgttctatgatgaacatcttcggtggaagaaaaatgatatgcttcaagtcctga

SEQ ID NO: 756 - protein, 214 aa, Zea mays
MASSASRFIKCVTVGDGAVGKTCMLICYTSNKFPTDYIPTVFDNFSANVVVDGTTVNLGLWDTAGQEDYNRLRPLSYRGADVFVLAFSLVSRASYENIMKKWIPELQHYAPGVPVVLAGTKLDLREDKHYLMDHPGLVPVTTAQGEELRRQIGAMYYIECSSKTQQNVKAVFDAAIKVVIQPPTKIREKKKKKSRKGCSMMNIFGGRKMICFKS

SEQ ID NO: 757 - DNA, 309 bp, Zea mays
  CDS (1)..(309)
atgacattcagcttaggtttttgggtattccagctttattctgacgactcaatcatccagccttgcaagttaactgtcgagacgattaaaccttcattccgatccagcaccagagccctgctgagcggctgcaccacggtaggctgcagactcttctgcatagcgttgcttgtcgacctgagactgctccacatatggctgcctctcctccgctgtcatcttttgccacctttctccgagcttctttgcaatctctgtggtcgccagttcaggattgctgctcttgatattagctcgctcagcctttga

SEQ ID NO: 758 - protein, 102 aa, Zea mays
MTFSLGFWVFQLYSDDSIIQPCKLTVETIKPSFRSSTRALLSGCTTVGCRLFCIALLVDLRLLHIWLPLLRCHLLPPFSELLCNLCGRQFRIAALDISSLSL

SEQ ID NO: 759 - DNA, 894 bp, Zea mays
  CDS (1)..(894)
atgtttgacattcttacagacaatgatgttcgcgaaggcatgaagaaattctccaactggcccactttccctcaactctactgcaaaggtgagctgcttggtggatgtgatattgttgttgctatgcacgaaagtggtgaattgaaggatgtttttgaggagcacaacattacccttaaaccacagggaagcaaaaatgaagaagcaggtgaacccgagtctgcaactgagaagggcagtgcagttgctgaaccaatcaagcttactgatgctcagaaaactcgtttggaaagccttattaactccagcccagtgatggtattcatcaaaggtacaccagaggaaccaaagtgtgggttcagtgggaagctggtccacatacttaagcaagagaatattcctttctcaagttttgacatcctttcagatgatgaagttagacaggggctgaaggtcctctcaaactggcccagttaccctcaactgtacataaaaggtgagctggttggcggctcagacatagtgatggagatgcacaagagtggtgagctgaagaaggttctgtctgagaaaggggttattccaaaggaaagcctggaggacagattgaagtccctggtttcctctgcaccggtgatgcttttcatgaagggcactcccgatgctcctcgttgcggcttcagttcgaaggttgtgaacgccttgaagaaggaaggggtcagctttgggtccttcgacatcttatctgacgaggaagttaggcaaggtttgaagacgtactccaactggcctaccttcccccagctctactacaaatcggagctgattgggggatgtgatatcgttcttgagatggagaagagcggagagctgaagtcgaccctgtcaatgtga

SEQ ID NO: 760 - protein, 297 aa, Zea mays
MFDILTDNDVREGMKKFSNWPTFPQLYCKGELLGGCDIVVAMHESGELKDVFEEHNITLKPQGSKNEEAGEPESATEKGSAVAEPIKLTDAQKTRLESLINSSPVMVFIKGTPEEPKCGFSGKLVHILKQENIPFSSFDILSDDEVRQGLKVLSNWPSYPQLYIKGELVGGSDIVMEMHKSGELKKVLSEKGVIPKESLEDRLKSLVSSAPVMLFMKGTPDAPRCGFSSKVVNALKKEGVSFGSFDILSDEEVRQGLKTYSNWPTFPQLYYKSELIGGCDIVLEMEKSGELKSTLSM

SEQ ID NO: 761 - DNA, 744 bp, Zea mays
  CDS (1)..(744): n means a or g or c or t/u
atgnnggttttgctgctctccgaccccgagctccgaaggccgcagcatcaggcgcggcccccctcgcgtgtgaccgagatggcgctgccgaatcaggggaccgttgattaccccagcttcaagctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaacctcaaggcttacttacaagaatgttcctacgtggcatagggacctgtgcagggtctgtgaaaacatccccattgtcctctgcggtaataaggttgatgtgaagaacaggcaggtcaaagccaagcaggttactttccacaggaagaagaatctgcagtactatgaaatttctgccaagagcaactacaactttgagaaacctttcctgtacctcgcaaggaagctggctggtgatccgaaccttcactttgttgaagctgttgctcttaagcctccggaagttaccatcgacatggctatgcagcagcagcatgaagctgagcttgctgcagcagctgcacaacctcttcctgatgacgatgatgatctgattgagtga

SEQ ID NO: 762 - protein, 247 aa, Zea mays
  misc_feature (2)..(2): Xaa can be any amino acid
MXVLLLSDPELRRPQHQARPPSRVTEMALPNQGTVDYPSFKLVIVGDGGTGKTTFVKRHLTGEFEKKYEPTIGVEVHPLDFTTNCGKIRFYCWDTAGQEKFGGLRDGYYIHGQCAIIMFDVTSRLTYKNVPTWHRDLCRVCENIPIVLCGNKVDVKNRQVKAKQVTFHRKKNLQYYEISAKSNYNFEKPFLYLARKLAGDPNLHFVEAVALKPPEVTIDMAMQQQHEAELAAAAAQPLPDDDDDLIE

SEQ ID NO: 763 - DNA, 597 bp, Zea mays
  CDS (1)..(597)
atggcacgcgagcccgcggccaccacctcgatgccactgacgggctggaatccgctggcgcccgtcctccagaccgtcgccgctttctcccgccacatcctcatcgcccccgacgccgggctcgacgaccaccgcctccgcccccttctagcgctctccctctccccgccttcgccggcaccaccgcaaccggaggtccggaaggagaagaaggatgccaaggaggcgccactgacgaaggaggaggtcggccgggccacgtggatgctgcttcacaccatcgcagcgcagttccctgacgaacctacgaggcaacaaagacgggatgcaaaggagttgatgcatataatctcgagactatatccttgcaaagaatgtgctgatcacttcaaggaagttttgaaagcaaatcctgtgcaggcaggatctcaggctgatttctcccagtggttatgttatgtccataacgtggttaatcgaagccttgggaagccaatatttccctgccaaagagtaactgcacgttggggtaaactggattgtcctgagcgctcgtgtgatctagaaggcagcatcgacatcatgccaaaccgatga

SEQ ID NO: 764 - protein, 198 aa, Zea mays
MAREPAATTSMPLTGWNPLAPVLQTVAAFSRHILIAPDAGLDDHRLRPLLALSLSPPSPAPPQPEVRKEKKDAKEAPLTKEEVGRATWMLLHTIAAQFPDEPTRQQRRDAKELMHIISRLYPCKECADHFKEVLKANPVQAGSQADFSQWLCYVHNVVNRSLGKPIFPCQRVTARWGKLDCPERSCDLEGSIDIMPNR

SEQ ID NO: 765 - DNA, 852 bp, Zea mays
  CDS (1)..(852): n means a or g or c or t/u
atgnggtcgaccatccatcgaacaggaaggatgacgggctccatggatctcccggccaagggcgggttcagcttcgacctgtgccgccggaacaacatgctggagaagaacgggctcaaggtcccgggattcaggaagaccgggacaaccatcgtcggcctcgtctttcaggatggggttgttcttggggcagacacaagggcaactgagggccccatagttgctgataagaactgtgagaaaatccactttatggcaccgaatatatactgctgtggagcaggaactgctgcggacacggaggccgttacagatatggtgagctcccagctacagcttcaccgttatgcaacgggccgcgaatcaagagttgtaactgctcttacactactgaagtcacacctcttcaagtatcaaggccatgtcagtgctgcccttgttcttggtggagtggattgtactgggccacatttacacactgtttatccacacgggtccactgatactcttccttttgccaccatgggctctggttctcttgctgcaatgtcagtgtttgaatcgaagtacaaagaaggccttactagggaggagggaatacagattgtgtgcgaagcaatctgtgctggtattttcaatgacttgggtagtgggagcaacgtggacgtctgcgtgataaccaaggggaagacagaatacttgagaaaccaccagttgccgaatcccaggacttatgctagttcaaagggatacagtttcaccaaggggcagactgaggtactgtcttcaaaggtcacacttctaaagcagaatgttgaggtcgccgagggtggtgatgctatggaggagtga

SEQ ID NO: 766 - protein, 283 aa, Zea mays
  misc_feature (2)..(2): Xaa can be Arg or Gly or Trp
MXSTIHRTGRMTGSMDLPAKGGFSFDLCRRNNMLEKNGLKVPGFRKTGTTIVGLVFQDGVVLGADTRATEGPIVADKNCEKIHFMAPNIYCCGAGTAADTEAVTDMVSSQLQLHRYATGRESRVVTALTLLKSHLFKYQGHVSAALVLGGVDCTGPHLHTVYPHGSTDTLPFATMGSGSLAAMSVFESKYKEGLTREEGIQIVCEAICAGIFNDLGSGSNVDVCVITKGKTEYLRNHQLPNPRTYASSKGYSFTKGQTEVLSSKVTLLKQNVEVAEGGDAMEE

SEQ ID NO: 767 - DNA, 855 bp, Zea mays
  CDS (1)..(855): n means a or g or c or t/u
atgnctacccgcgacgaagcatcaccagtaaggatgacgggctcaatggatctcccggccaagggcgggttcagcttcgacctgtgccgccgcaacagcatgctggagaagaacgggctcaaactcccgggattcaggaagaccggaacaaccatcgtcggcctcgtctttcaggatggggttgttcttggggcagacacaagagcaactgaggggcctatagttgctgataagaattgtgagaagatccactttatggcgccaaacatttattgttgtggagcaggaactgctgctgacactgaggctgttacagacatggtcagctcacagctacagctgcaccgttatgcaacgggtcgcgaatctagagtcgtaactgctcttacactgctgaagtcacatctctttaggtatcaaggccatgtcagtgctgcccttgttcttggtggagtggattgtactggaccacatcttcacactgtttatccacacggctccactgatactcttccttttgccacgatgggttctggatcccttgctgcaatgtcagtgtttgaatcgaagtataaagaaggcctcactagggaagagggaatacaactggtgtcagaagcaatatgtgcaggtatcttcaatgacttgggtagtggaagcaatgtggatgtctgcgtgataaccaaggggaagacagaatacttgagaaatcaccagttgccgaatcccagaacttatgttagttcaaagggatatagcttcaccaaggggcagactgaggtgctgtccgcaaagatcacacatctcaagcagaaggttgaggtcactgagggcggtgatgctatggaggagtga

SEQ ID NO: 768 - protein, 284 aa, Zea mays
  misc_feature (2)..(2): Xaa can be Thr or Ala or Pro or Ser
MXTRDEASPVRMTGSMDLPAKGGFSFDLCRRNSMLEKNGLKLPGFRKTGTTIVGLVFQDGVVLGADTRATEGPIVADKNCEKIHFMAPNIYCCGAGTAADTEAVTDMVSSQLQLHRYATGRESRVVTALTLLKSHLFRYQGHVSAALVLGGVDCTGPHLHTVYPHGSTDTLPFATMGSGSLAAMSVFESKYKEGLTREEGIQLVSEAICAGIFNDLGSGSNVDVCVITKGKTEYLRNHQLPNPRTYVSSKGYSFTKGQTEVLSAKITHLKQKVEVTEGGDAMEE

SEQ ID NO: 769 - DNA, 669 bp, Zea mays
  CDS (1)..(669): n means a or g or c or t/u
atgttcgatcaggtcatcatcgtcatcagggaggggttgcgcagcggcagctgcaagctcagcttcatgctgctgctgcatggccatatcaatctgcacttccggtggcttcagagcaacggcttcgacaaagtgaaggttctgatcccctgccagcttccttgcgaggtaaaggaagggcttctcaaagttgtaattgctcttggcagaaatctcatagtactgcaagttcttcttcctgtggaatgtaacttgcttggctttgacctgcctgttctttacatcaaccttgtttccgcagagaacgatggggatgttctcacacaccctgcacaggtccctgtgccatgttggaacattcttgtatgtcagcctcgaagtgacatcaaacataatgatggcacactgaccatgaatgtagtagccatccctgaggccaccgaacttttcttgcccagcagtgtcccagcaatagaagcgaattttgccacagttagtgctaaaatccagagggtgaacttcaacaccaatggtgggctcatatttcttctcaaactcgccagtaagatgcctcttcacaaatgtggttttgccagttccaccgtcgccaacgatgacgagcttgaagctggggtaatccacaacctgctgattcggcagcgccnntga

SEQ ID NO: 770 - protein, 222 aa, Zea mays
  misc_feature (222)..(222): Xaa can be any amino acid
MFDQVIIVIREGLRSGSCKLSFMLLLHGHINLHFRWLQSNGFDKVKVLIPCQLPCEVKEGLLKVVIALGRNLIVLQVLLPVECNLLGFDLPVLYINLVSAENDGDVLTHPAQVPVPCWNILVCQPRSDIKHNDGTLTMNVVAIPEATELFLPSSVPAIEANFATVSAKIQRVNFNTNGGLIFLLKLASKMPLHKCGFASSTVANDDELEAGVIHNLLIRQRX

SEQ ID NO: 771 - DNA, 486 bp, Zea mays
  CDS (1)..(486): n means a or g or c or t/u
atggtcttccagctcctggttccttcgtttggcaagcatgaccttggtgaactcggtgtagttgatctggccatcgccgtcggcgtcggcctcgcggagcatctcggcgagctcgtcgtcggagaggcgctcgccgaggttctggaggacgtggcggagctcttcgcgggagatgaagccgttctggtcctggtcgaagacgcggaaggcctctcgcagctcctcctcgtcggcgccgctggcctcccgcatctggcgcgccatcagggtgaggaactcctggaagtcgatggcgccgctgccgtccgcgtccacctcgtccaccatgccctgcagctcctcctccgtcggcgtctgccccagcgaccgcatcaccgtgcccagctccttggtcgtgatcgtcccgtcgccatctttgtcgaagaggctgaacgcctcccggaactcctcgatctgtttcttggccgctgcgtgtcggtctcntga

SEQ ID NO: 772 - protein, 161 aa, Zea mays
MVFQLLVPSFGKHDLGELGVVDLAIAVGVGLAEHLGELVVGEALAEVLEDVAELFAGDEAVLVLVEDAEGLSQLLLVGAAGLPHLARHQGEELLEVDGAAAVRVHLVHHALQLLLRRRLPQRPHHRAQLLGRDRPVAIFVEEAERLPELLDLFLGRCVSVS

SEQ ID NO: 773 - DNA, 1245 bp, Zea mays
  CDS (1)..(1245)
atggaccggatcgtaggcagcaagtacaagctgggtcgcaagatcggaagcggttccttcggggagatctacctcgcgacgcacgtcgacacctacgagatcgtcgccgtcaagattgaaagcagcaaaaccaatcatccacagttgctatatgaggccaaactgtacaatgctcttcaaggagggactggtatcgcaaacataaaatggtgcggcattgacggcgatgaaaacattcttgttattgatttactcggaccaagccttgaagatctgtttgtttattgtggccggagattctcactgaagacggtcttgatgctagcggaccagatgataacaagaatagaatttatgcattctaaaggctatctgcacagagacatcaagcctgataacttcctcatgggccttggtcgaaaagctaaccaggtttatgtaattgacttcgggcttgcaaagagatatcgtgattcagccaccaaccgccatataccttatagagaaaataaaaacttgactggcacagctcgctatgctagccgtaatactcatcttgggattgagcaaagccgcagagatgatttggaatcgatcggatacgttcttctgtatttccttaggggaagtcttccttggcagggcttgaaagcagccacaaagaaacagaagtatgacaaaataagtgagaagaagctttcgactcctattgaggctctatgtaaatcccatcctgtggaatttgcttcctatttccactactgccattctctgacatttgatcagcgtcccgattatagtttcttgaggcatgtctttcgagaattgtttgagcgcgaaggctatcaatttgattatgtgtatgactggactttgttgaagtgtaagcaatcccagaaggctaaggttcagcaaggatgctctcatgatgcaggcgtaagcagccgtccagttgcaacaaacgtggacaagcaccaagttggtgttgcacgcccaattaatgcttcaggtctgcttgaagcagaacaacgcccggcaatcagaatgcaattaaacagccgttccaataatctgcatcctgagagattgggagtgtctgctagtcataataatgtactgctgcaatccacgtcacttgacaatgctgatgctccaatggaccacgcgacacattcaaaagcacaggggtccattgatccacacactcgtggaagttatagtccagggccctctaaccgcacttga

SEQ ID NO: 774 - protein, 414 aa, Zea mays
MDRIVGSKYKLGRKIGSGSFGEIYLATHVDTYEIVAVKIESSKTNHPQLLYEAKLYNALQGGTGIANIKWCGIDGDENILVIDLLGPSLEDLFVYCGRRFSLKTVLMLADQMITRIEFMHSKGYLHRDIKPDNFLMGLGRKANQVYVIDFGLAKRYRDSATNRHIPYRENKNLTGTARYASRNTHLGIEQSRRDDLESIGYVLLYFLRGSLPWQGLKAATKKQKYDKISEKKLSTPIEALCKSHPVEFASYFHYCHSLTFDQRPDYSFLRHVFRELFEREGYQFDYVYDWTLLKCKQSQKAKVQQGCSHDAGVSSRPVATNVDKHQVGVARPINASGLLEAEQRPAIRMQLNSRSNNLHPERLGVSASHNNVLLQSTSLDNADAPMDHATHSKAQGSIDPHTRGSYSPGPSNRT

SEQ ID NO: 775 - DNA, 1323 bp, Zea mays; identical to SEQ ID NO: 351
  CDS (1)..(1323)

SEQ ID NO: 776 - protein, 440 aa, Zea mays; identical to SEQ ID NO: 352

SEQ ID NO: 777 - DNA, 582 bp, Zea mays
  CDS (1)..(582)
atgaaaattgaatatcagatcaagctcacagacattgccaaagtagcggtccaatatctcaacatagtgatggatgatctgaagggtttccagttcattgtcagcggggtcaatgcacatgcagaagtaaaggctagcatacctcttgtacacaactctgtaaccttgccagtcgacaaaattgcacagcttggggcctcttgtcaggacgagcgtactaatctctttgatgatcttggatctctgcttctgtgggtatggagtgtaccatttcgtcagcctcaccttcccctgcctgctgatgaggagcacaaaatgtatcatgattcgcgcttcgaaggagaatcgtgggccgtagtcgtcgacgttgatcgccgccgccgcaggagagagtcgatcgcccacgagaggaaaggagagttgaggccttcacgaatcacgaacggtttgatttctcgcttgaatcgctcatccgactacgcggctataccatcgcagttctacgcatgtaggccctatggggtggcatgtatccgcgcgaacggggccacatggccacgcctcgaccactacgcgaattga

SEQ ID NO: 778 - protein, 193 aa, Zea mays
MKIEYQIKLTDIAKVAVQYLNIVMDDLKGFQFIVSGVNAHAEVKASIPLVHNSVTLPVDKIAQLGASCQDERTNLFDDLGSLLLWVWSVPFRQPHLPLPADEEHKMYHDSRFEGESWAVVVDVDRRRRRRESIAHERKGELRPSRITNGLISRLNRSSDYAAIPSQFYACRPYGVACIRANGATWPRLDHYAN

SEQ ID NO: 779 - DNA, 666 bp, Zea mays; identical to SEQ ID NO: 577
  CDS (1)..(666)

SEQ ID NO: 780 - protein, 221 aa, Zea mays; identical to SEQ ID NO: 578

SEQ ID NO: 781 - DNA, 687 bp, Zea mays
  CDS (1)..(687)
atgcccagatccatcgactcgctcgggccgcccctcccgtcgtccccgttcgaaggtgcggcagccggcaggcgagcgatttcattcgacatgaatcccgagtacgactaccttttcaaacttctgcttattggtgattctggtgttgggaaatcatgcttgcttctcagatttgcagacgattcttatttggacagctatatcagcacaattggggttgatttcaaaattcgcacagtggagcaagatgggaagaccataaaacttcaaatttgggatactgctgggcaagagcgcttcaggacaatcactagcagctactaccgcggagctcatggaatcattattgtatatgacgtgacagaccaagaaagcttcaataatgtgaagcaatggttgaacgagatagaccgttatgcaagtgataatgttaacaagctccttgttgggaacaagagtgaccttactgccaacaaagttgtggcaactgagacagcaaaggcgtttgctgatgagatgggcatcccattcatggagacgagtgccaaaaacgccatcaacgtggagcaggccttcatggctatggctgcatccatcaaggataggatggccagccaaccagccgcggccaacgcaaggccagcgaccgtgcagatccgcgggcaacccgtcaaccagaagacgtga

SEQ ID NO: 782 - protein, 228 aa, Zea mays
MPRSIDSLGPPLPSSPFEGAAAGRRAISFDMNPEYDYLFKLLLIGDSGVGKSCLLLRFADDSYLDSYISTIGVDFKIRTVEQDGKTIKLQIWDTAGQERFRTITSSYYRGAHGIIIVYDVTDQESFNNVKQWLNEIDRYASDNVNKLLVGNKSDLTANKVVATETAKAFADEMGIPFMETSAKNAINVEQAFMAMAASIKDRMASQPAAANARPATVQIRGQPVNQKT

SEQ ID NO: 783 - DNA, 513 bp, Zea mays
  CDS (1)..(513)
atgacgagacgtaaactagtcacaactcaggaccagtgcctcttcggtcaaaaatatccttgtacctgcatctcgacctcaccggcgtccggcggtggtatcacgatggtggcgttgctgggccggcggatcggggtggctgcggcagctgccgcgttcatcgccctcgtggcgttcggatccgcctcatcctcgcccaagtccttcgtgaagtccaccgtctccgcccacgacgtcgtcatcttctccaagtcatactgcccgtactgcaaaagagcaaaggccgtgtttaaggagcttgagttgaagaaagagccatatgttgtggagcttgatcagcgagaggatggctcagagattcaggatgccttacttgagatagttggcaggcgtactgtccctcaagtttttgtccatggaaagcacctgggtggttctgacgatactgttgactcctacgaaagtggaaaactggctagacttctaaacatcggagtcaaggacgacctttga

SEQ ID NO: 784 - protein, 170 aa, Zea mays
MTRRKLVTTQDQCLFGQKYPCTCISTSPASGGGITMVALLGRRIGVAAAAAAFIALVAFGSASSSPKSFVKSTVSAHDVVIFSKSYCPYCKRAKAVFKELELKKEPYVVELDQREDGSEIQDALLEIVGRRTVPQVFVHGKHLGGSDDTVDSYESGKLARLLNIGVKDDL

SEQ ID NO: 785 - DNA, 666 bp, Zea mays
  CDS (1)..(666)
atggccagccgcgggcagcagccatcagccatgagcgaggtgttcgagggctacgagcggcagtactgcgaggcctccgcctcgctctcccgcaagtgcacggctgcatccgccctcgatggagagaggaagaagcagaagctctccgagatccagtccggcgttgaggaagctgaatcgctgattcggaagatggacctggaggcaaggagcctacagcctagcattaaggctggtttgcttgcaaagctgagggagtataaatctgacctcaacaacgtcaagagtgagctcaagaggatatctgcgcccaatgccaggcaggctacccgggaggagctcctggagtctggaatggctgatactctcgcggtgtctactgatcagaggggaagattgatgatgacaactgaaagactgaatcagtccactgacagaattaaagagagccgaagaactatgttggagacagaagaacttggtgtctcgattcttcaggaccttcaccaacagaggcagtcactactacatgctcatactactttgcacggagttgatgataacattggcaagagcaagaagatcctggctgcaatgtcaaagaggatggataggaacaagtggatcattgggggaatcatcacggctctcgctctggccatctga

SEQ ID NO: 786 - protein, 221 aa, Zea mays
MASRGQQPSAMSEVFEGYERQYCEASASLSRKCTAASALDGERKKQKLSEIQSGVEEAESLIRKMDLEARSLQPSIKAGLLAKLREYKSDLNNVKSELKRISAPNARQATREELLESGMADTLAVSTDQRGRLMMTTERLNQSTDRIKESRRTMLETEELGVSILQDLHQQRQSLLHAHTTLHGVDDNIGKSKKILAAMSKRMDRNKWIIGGIITALALAI

SEQ ID NO: 787 - DNA, 378 bp, Zea mays
  CDS (1)..(378)
atgcttgccactctcacaaatcaagttttcatgtctgatctcgacattcagatcccaactgccttcgatcccttcgctgaggccaatgctggggactctggtgcggcagcagggtcaaaggactacgttcacgtgcgcatccagcagcgtaatggtcgcaagagcctgactaccgtccagggattgaagaaggagttcagctacagcaagatcctcaaagatctcaagaaagagttctgctgcaatggtacagtggtccaggacccagaacttggacaggtcattcagctccagggtgatcagaggaagaacgtctcgaatttcctcgtccaggccggcattgtgaagaaggagcacatcaagattcatggtttctga

SEQ ID NO: 788 - protein, 125 aa, Zea mays; identical to SEQ ID NO: 336

SEQ ID NO: 789 - DNA, 924 bp, Zea mays
  CDS (1)..(924): n means a or g or c or t/u
atgnngggtcgacttcgctgtcgacgatttcgtcccttcccctcggcctcaagagctctgcggttgccgcggccaagggcgtccgtggagaagcgggagcaggtggcggcgatggaagagcaaggcggccaggcggcgctcgggtgggcggccagggacgactccggcgtcctctccccctacagcttctccagaagggttcctaaagacgacgatgtcacgatcaaggtgctctactgcgggatctgccacaccgacctgcacgtcatcaagaacgactggcgaaacgccatgtacccagtcgtcccggggcacgagatcgtgggcgtggtgaccggcgtcggcggcggcgtcacgcggttcaaggccggcgacacggtcggcgtgggctacttcgtggggtcctgccgctcctgcgacagctgcggcaagggggacgacaactactgcgcggggatcgtgctcacctccaacggcgtcgaccacgcgcacggcggcgcgcccaccagggggggattctccgacgtcctggtcgcgagcgagcactacgtggtccgcgtccccgacggcctggcgctggaccgcaccgcgccgctgctctgcgccggcgtcaccgtgtacagccccatgatgcgccacggcctcaacgagcccggcaagcacctcggcgtcgtcggcctcggcggcctcggccacgtcgccgtcaagttcggcaaggccttcgggatgaaggtcaccgtcatcagcacgtccgccagcaagcgccaggaggccatcgagaacctcggcgcggacgagttcctcatcagccgggacgaggaccagatgaaggcggcgacggggaccatggacggcatcatcgacacggtgtcggcgtggcacccgatcacgccgctgctggcgctgctgaagccgctggggtga

SEQ ID NO: 790 - protein, 307 aa, Zea mays
  misc_feature (2)..(2): Xaa can be any amino acid
MXGRLRCRRFRPFPSASRALRLPRPRASVEKREQVAAMEEQGGQAALGWAARDDSGVLSPYSFSRRVPKDDDVTIKVLYCGICHTDLHVIKNDWRNAMYPVVPGHEIVGVVTGVGGGVTRFKAGDTVGVGYFVGSCRSCDSCGKGDDNYCAGIVLTSNGVDHAHGGAPTRGGFSDVLVASEHYVVRVPDGLALDRTAPLLCAGVTVYSPMMRHGLNEPGKHLGVVGLGGLGHVAVKFGKAFGMKVTVISTSASKRQEAIENLGADEFLISRDEDQMKAATGTMDGIIDTVSAWHPITPLLALLKPLG

SEQ ID NO: 791 - DNA, 1521 bp, Zea mays
  CDS (1)..(1521)
atgctccacctcgccgccgccgctcggatttccctctacctcaccctgtccggctccatggcgaccgccgcggtggagagcaagaggggcagcgcccggggccgcaaggcgctcgtggccgtgctcgacaacgaggctaacatctccgccgggaaggccgcccaggccgccgatctctcgtcctgctcagcgcagaagaaggcgaagcgggcgccgtcaaggagcagcaaggccaaggccgccgcggcgtcggcggccgtggtcgtggacgacatagccgagctgcaggggatgctagagcgcctgcggctggagaaggagaaggcggaggagatggttagggagcgggatgaggtcatccggaagaaggaggaggagatcgagaccagagacaaggagcaggagcgtctccaggccgagctcaggaaggcgcaacgcgccaaggagttcaagcctaccgtgagcttccccctcgtcaagtcgttgctggagaaagagcaagaagcagacgacaagggaaagaagaagaaggggaagggcggccacgagaggaagaagccgtgcccggcgtacgtgctctggctcaaggaccagtggaccgaggtcaagaaggagaaccctgaggccgacttcaaggaggtgtccaacacgctgggcgccaagtggaaggctctgggcgccgaggagaagcagccctatgaggatcgataccgccaggagaaggaggcctacctgcaggtggttggccaggagaagcgcgaggccgaggcgatgaagcttctcgaggagcagcagatgcagtggaccgccaaggagctgctggatcagtacctcaagttcaggcaggaggccgaggagggtgactgcaagaaggggaggaagaagaagagcaagaaggacaaggacccatccaagcccaagcagcccatgtcggcctacttcgtgtactcgcaggagaggcgtgccacgctggtcgcggagaagaagaatgtacctgagattggcaagatcaccggcgaagaatggaagaacatgacagaaggtcagagggctccctatgaggaggtcgcgaggaagcagaaggaagagtaccacaagcagatggaggtgtacaagcagaagaaggctgaggaagctgctagtcttgagaaggaagagcaggagcataagaaaatcatgaagcatgaggctctccagctgctcaagaagaaggagaaggcagataatatcatcaagaaaaccaaagaaaagcgccagaagaagaagcaggagaacgctgatcccaaccggcccaagaggccagcctcttcctttcttcttttcagcaaggaagcgaggaagcagctgatcgaggaacgcccgggcatcaataactcaaccctgaacgcgctcatcacggtgaagtggaaggaactgagcggcgaggagaggcaggcctggaatgcaaaggccgcgcctgccatggctgcatacaagaaggagatggaggagtacactaaggcccaaagctcatctgcttga

SEQ ID NO: 792 - protein, 506 aa, Zea mays
MLHLAAAARISLYLTLSGSMATAAVESKRGSARGRKALVAVLDNEANISAGKAAQAADLSSCSAQKKAKRAPSRSSKAKAAAASAAVVVDDIAELQGMLERLRLEKEKAEEMVRERDEVIRKKEEEIETRDKEQERLQAELRKAQRAKEFKPTVSFPLVKSLLEKEQEADDKGKKKKGKGGHERKKPCPAYVLWLKDQWTEVKKENPEADFKEVSNTLGAKWKALGAEEKQPYEDRYRQEKEAYLQVVGQEKREAEAMKLLEEQQMQWTAKELLDQYLKFRQEAEEGDCKKGRKKKSKKDKDPSKPKQPMSAYFVYSQERRATLVAEKKNVPEIGKITGEEWKNMTEGQRAPYEEVARKQKEEYHKQMEVYKQKKAEEAASLEKEEQEHKKIMKHEALQLLKKKEKADNIIKKTKEKRQKKKQENADPNRPKRPASSFLLFSKEARKQLIEERPGINNSTLNALITVKWKELSGEERQAWNAKAAPAMAAYKKEMEEYTKAQSSSA

SEQ ID NO: 793 - DNA, 363 bp, Zea mays
  CDS (1)..(363)
atgcaaccaagtttcatgtctgatctcgacgtccagcttccatctgcctttgatccgtttgctgaggcaaatgctgaggactctggtgctggtcctggaacgaaggattatgtgcatgtgcgcatccagcagcgcaacggcagaaagagtctgactacagtccagggtctgaagaaagagttcagctataacaagatcctcaaggatctgaagaaggaattctgctgcaatggtactgtagttcaggacccagagctaggccaggtcattcagctccaaggtgaccagcgcaagaatgttgctactttcctagttcaggctgggattgcgaagaaagagaacatcaagattcacgggttctga

SEQ ID NO: 794 - protein, 120 aa, Zea mays
MQPSFMSDLDVQLPSAFDPFAEANAEDSGAGPGTKDYVHVRIQQRNGRKSLTTVQGLKKEFSYNKILKDLKKEFCCNGTVVQDPELGQVIQLQGDQRKNVATFLVQAGIAKKENIKIHGF

SEQ ID NO: 795 - DNA, 723 bp, Zea mays
  CDS (1)..(723): n means a or g or c or t/u
atgctgggctcggagaatcggagacaggcgcgcgcggcaatggcgtccagcgcctctcggttcatcaagtgcgtcacggtcggcgacggtgccgtgggcaagacatgtatgctcatctgctacaccagcaacaagttccccactgattacatacccacggtgttcgacaatttcagtgcaaatgtcgttgtggatggcaccacggtgaatttgggcctgtgggataccgcagggcaggaagattacaaccgactgaggcctctaagctaccgtggtgcagatgttttcgtgcttgcattctcacttgtgagtcgagctagctatgagaatatcatgaagaagtggataccggagcttcagcattatgcacgtggggtgcctgttgtgttggtaggcacaaaatttgatcttcgtgaagacaagcactacttgatggaccatcctgggttggtgcctgttaccacagcacaaggggaggaacttcgtagacaaattggtgctatgtattacatcgaatgcagttcgaagacacagcagaatgtcaaagctgtgttcgatgctgccatcaaggttgtaatccagcctccaactaaactaagagaaaagaagaaaaagaaatcacgcaagnggatgttcgatggtgaacatcttatctggaagaaaaatgctatgcttcaagtcctgaatgatcgaagggggtcttacctgaaanaataccantga

SEQ ID NO: 796 - protein, 240 aa, Zea mays
  misc_feature (210)..(210): Xaa can be Arg or Gly or Trp
  misc_feature (238)..(238): Xaa can be any amino acid
  misc_feature (240)..(240): Xaa can be Gln or His
MLGSENRRQARAAMASSASRFIKCVTVGDGAVGKTCMLICYTSNKFPTDYIPTVFDNFSANVVVDGTTVNLGLWDTAGQEDYNRLRPLSYRGADVFVLAFSLVSRASYENIMKKWIPELQHYARGVPVVLVGTKFDLREDKHYLMDHPGLVPVTTAQGEELRRQIGAMYYIECSSKTQQNVKAVFDAAIKVVIQPPTKLREKKKKKSRKXMFDGEHLIWKKNAMLQVLNDRRGSYLKXYX

SEQ ID NO: 797 - DNA, 270 bp, Brassica napus
  CDS (1)..(270)
atggcgagcaacaatccttcgcagcttcttccatcagagctaatcgacaggtgcatagggtcgaagataagggtgataatgaaaggagataaggagctcgtcggtgttctcaaaggcttcgacgtttacgtcaacatggtccttgaggatgtcaccgagtatgagattacagctgaaggaagtcgggtcacaaagcttgatcagattctcctcaacggcaacaacatcgccattttggtgcctggtggagctccagaagatgtagagtga

SEQ ID NO: 798 - protein, 89 aa, Brassica napus
MASNNPSQLLPSELIDRCIGSKIRVIMKGDKELVGVLKGFDVYVNMVLEDVTEYEITAEGSRVTKLDQILLNGNNIAILVPGGAPEDVE

SEQ ID NO: 799 - DNA, 1341 bp, Glycine max
  CDS (1)..(1341)
atgagagaaatccttcatgttcaagctggtcaatgtggcaaccaaattggaggcaagttttgggaggtgatgtgtgatgaacatgggattgatgccactggaaattacgtaggcaattcccatcttcaacttgagagggttaacgtgtactacaatgaagcaagtggaggacgctatgttcctcgagctgtgcttatggaccttgaaccagggaccatggatagcttgcgttctggtccttttggaaaaatattcagacctgataatttcgtgttcggccaaaatggagctggtaacaactgggctaaagggcattatactgagggagctgagcttattgattctgttctggatgttgttcgaaaagaagctgagaactgtgactgcttgcaggggttccaaatttgtcactcactgggaggaggaactgggtctggaatgggtaccttgcttatctcaaagatcagagaagagtatccggataggatgatgttgacattctcagtgttcccgtctccaaaggtctctgacaccgtggttgaaccctacaatgccactctctctgttcatcaactagttgagaatgcggatgaatgcatggtccttgataacgaggcactctatgatatctgtttccgtacactcaagctcacaaatccaagttttggtgatctgaaccacttgatctcaacaacaatgagcggggtaacgtgctgcctccgcttccccgggcagctgaactccgacctccgcaaactcgccgtaaacctaatccctttccctcgcctccacttcttcatggtcggtttcgcgcccctcacatcccgcggctcccagcagtaccgctccctcaccatcccggaactcacccagcaaatgtgggacgcgcggaacatgatgtgcgccgccgatcctcggcacggcaggtacctgacggcgtccgccatgttccgcggcaagatgagcaccaaagaagtggaccagcagatgatcaacgtgcagaacaagaactcctcctacttcgtggagtggatccccaacaacgtcaagtccagcgtctgtgacatccctcccacgggcctctccatgtcctccaccttcatggggaactccacctccattcaggagatgtttcgccgcgtctccgagcagttcactgtcatgttcaagagaaaagccttcttgcattggtacactgccgagggaatggatgagatggagtttaccgaggctgagagcaacatgaatgacttggtggcagagtatcaacagtatcaagacgccgccgccagcgaagaaggcgagaacgagatcgatgacgaggaagccatggctgcatga

SEQ ID NO: 800 - protein, 446 aa, Glycine max
MREILHVQAGQCGNQIGGKFWEVMCDEHGIDATGNYVGNSHLQLERVNVYYNEASGGRYVPRAVLMDLEPGTMDSLRSGPFGKIFRPDNFVFGQNGAGNNWAKGHYTEGAELIDSVLDVVRKEAENCDCLQGFQICHSLGGGTGSGMGTLLISKIREEYPDRMMLTFSVFPSPKVSDTVVEPYNATLSVHQLVENADECMVLDNEALYDICFRTLKLTNPSFGDLNHLISTTMSGVTCCLRFPGQLNSDLRKLAVNLIPFPRLHFFMVGFAPLTSRGSQQYRSLTIPELTQQMWDARNMMCAADPRHGRYLTASAMFRGKMSTKEVDQQMINVQNKNSSYFVEWIPNNVKSSVCDIPPTGLSMSSTFMGNSTSIQEMFRRVSEQFTVMFKRKAFLHWYTAEGMDEMEFTEAESNMNDLVAEYQQYQDAAASEEGENEIDDEEAMAA

SEQ ID NO: 801 - DNA, 264 bp, Glycine max
  CDS (1)..(264)
atggccaacaatccgtcacagcttctcccatcagagttgattgaccggtgtataggttcgaaaatttgggtgataatgaagggtgacaaggagcttgttggtactcttagaggctttgatgtttatgtcaacatggtccttgaagatgttactgaatatgagatcactgctgaagggagacggataaccaagcttgatcagattttactcaatggaaacaacattgccattttggtccctggtggttctcctgagtcagaatga

SEQ ID NO: 802 - protein, 87 aa, Glycine max
MANNPSQLLPSELIDRCIGSKIWVIMKGDKELVGTLRGFDVYVNMVLEDVTEYEITAEGRRITKLDQILLNGNNIAILVPGGSPESE

SEQ ID NO: 803 - DNA, 1236 bp, Oryza sativa
  CDS (1)..(1236)
atggcggctgcggcggcgcggctgttggagagggcgacgagaaccgcggcatcctgctcctccgctcttctccgcagtcctctggattctttctccggacgcttcccaagcttccggtcgcccctcctacggccggctccggcgccgtcgaccgtcttcccccggggcctctccgacacggccttcgacgcgcaggcgctggacacccgcgtacccgccaccgtcatcaccggcttcctcggctccggcaagacaaccctcctgaatcacattttaacttcacagcatgggaagagaatcgctgtaattgagaacgagtttggtgaggtggacattgatagctcactcgttgcaagtcattcatcagttgccgaggacattgtaatggtgaacaatggttgcttgtgttgtactgtccgaggggatcttgtaaagatgcttctgaagttggtaaagcaaaagggggacaagtttgatcatattgttattgaaacaacaggtcttgcaaagcctggtcctgtcattgagacattctgttctgatgaactggtctctagatatgtgaagcttgatggtgtggttactatggttgattgtaagcatgccatgaaacatttgaatgaagtaaaggccaggtgggttgtaaatgaggctgtagagcaagttgcttatgcagacaggattatattgaacaagactgatttggttgataatgcagaactggaggtgttaattaacaaaattaagctcataaatgggatggcacagatgagaaaaacaaagtttggtgatgttgacatggattttgtgctaggaattgggggctatgatcttgataggattgagtctgaagtccagttgcatgaaagaaaagagacaggtcattgccatgctggagaagaacatgggcatcagcaccatcatggacatgtccatgattcagctgtctcaagtgttagcattgtttcggagggagtacttgatcttgatgaggtgaatgactggcttgagagactcgttgaagagaaaggggaggatctttatagattgaagggtgtaatctccgtaaatgagtcaactggacgtttcgtattccagggtgtgcactctatgttggagggatgcccagctaaaccatgggagccggatgagaaaagattcaacaaattagtatttattggaaggaatttggatgaagctgcactgcgaaaagccttcaaaggctgcttactgtga

SEQ ID NO: 804 - protein, 411 aa, Oryza sativa
MAAAAARLLERATRTAASCSSALLRSPLDSFSGRFPSFRSPLLRPAPAPSTVFPRGLSDTAFDAQALDTRVPATVITGFLGSGKTTLLNHILTSQHGKRIAVIENEFGEVDIDSSLVASHSSVAEDIVMVNNGCLCCTVRGDLVKMLLKLVKQKGDKFDHIVIETTGLAKPGPVIETFCSDELVSRYVKLDGVVTMVDCKHAMKHLNEVKARWVVNEAVEQVAYADRIILNKTDLVDNAELEVLINKIKLINGMAQMRKTKFGDVDMDFVLGIGGYDLDRIESEVQLHERKETGHCHAGEEHGHQHHHGHVHDSAVSSVSIVSEGVLDLDEVNDWLERLVEEKGEDLYRLKGVISVNESTGRFVFQGVHSMLEGCPAKPWEPDEKRFNKLVFIGRNLDEAALRKAFKGCLL

SEQ ID NO: 805 - DNA, 1635 bp, Brassica napus
  CDS (1)..(1635)
atgcaatcgtcaacgtacgcagctgttaaaggaaacgctgcgtttgcgtttcagagacgtagcttctctaacctcgtcagcagatcggcgactactaccggaattcgcttctccaccggctcttacttcgcacaactccactcttccgcctcgaaagccatgggagcgaagcttgctcgcgctgagaacgggattcacagtctctcctcggtcaaagctcgatcggttagagcacaagcctcctctggtggtggtgacgaagaagaagcaatacctctgagatctgaaggaaaaatctcagggacggttttacccttcgttggtgttgcttgtcttggtgctatcttgtttggttatcatctcggggttgttaacggtgctcttgagtaccttgctaaggatcttggtatcgctgataatgctgttttgcaagggtggattgttagcgcgttgcttgctggtgcaacggtcggttctttcaccggaggtgcattagctgacaaatttggaagaactagaacttttcaattggatgctatcccgcttgctattggagctttcttatgtgcaacagctcagagtgtgcagactatgattgtgggacgtctgctcgcaggggttggaatcggaatctcatcagccattgtaccactttacatctccgagatatcaccaactgaaattcgcggtgcactcggatctgtgaaccagttgttcatatgtattggaatactcgcagccttgatagctggattaccccttgcagcaaaccctctatggtggaggacgatgtttggtgttgcagttatcccttccgttctattagccataggaatggggttttctccagaaagcccaaggtggctcgttcagcaaggaaaacttactcaagcggaaaaggctatcaaaactctgtatggtaaagaaaaagtggttgaactagtgcgtgacttatcaaactctggccaaggtacttctgagccagaggcaggatggtttgatctattcagcagccgctactggaaagttgtaagcgttggtgcggcgctcttcttgtttcagcagttagctgggataaatgcagttgtgtactactctacatctgtgttccgcagcgccggaatccaatctgatgttgcagccagtgctcttgttggagcatcaaacgtgtttggaactgctgttgcttcgtctttgatggacaaaatgggaaggaaaagtcttctacttactagctttggtggaatggcgttgtctatgctgttgctctcgttgtccttcacatggaaggctcttgctgcatattctggcactcttgctgttgttggaactgttctatatgtcctgtcattttcgcttggtgctggcccagtaccggctcttttgcttccagagatattcgcatccaggatcagagcaaaagccgtcgctctttctctcggcatgcactggatctcaaactttgtgattggactctacttcttgagcgttgtgactaaattcggaatcagcagtgtctacttgggattcgcaggagtgtgtgtccttgcagtcatgtacattgcaggaaacgtggtggagactaaaggacggtcactcgaggaaatagagcttgctcttacatccggagcttaa

SEQ ID NO: 806 - protein, 544 aa, Brassica napus
MQSSTYAAVKGNAAFAFQRRSFSNLVSRSATTTGIRFSTGSYFAQLHSSASKAMGAKLARAENGIHSLSSVKARSVRAQASSGGGDEEEAIPLRSEGKISGTVLPFVGVACLGAILFGYHLGVVNGALEYLAKDLGIADNAVLQGWIVSALLAGATVGSFTGGALADKFGRTRTFQLDAIPLAIGAFLCATAQSVQTMIVGRLLAGVGIGISSAIVPLYISEISPTEIRGALGSVNQLFICIGILAALIAGLPLAANPLWWRTMFGVAVIPSVLLAIGMGFSPESPRWLVQQGKLTQAEKAIKTLYGKEKVVELVRDLSNSGQGTSEPEAGWFDLFSSRYWKVVSVGAALFLFQQLAGINAVVYYSTSVFRSAGIQSDVAASALVGASNVFGTAVASSLMDKMGRKSLLLTSFGGMALSMLLLSLSFTWKALAAYSGTLAVVGTVLYVLSFSLGAGPVPALLLPEIFASRIRAKAVALSLGMHWISNFVIGLYFLSVVTKFGISSVYLGFAGVCVLAVMYIAGNVVETKGRSLEEIELALTSGA

SEQ ID NO: 807 - DNA, 450 bp, Glycine max
  CDS (1)..(450)
atggccgatcaacttaccgatgaacagatctccgagttcaaggaagccttcagcttgttcgacaaggacggcgatggttgcatcacaaccaaggagcttggaactgttatgcgttcattggggcaaaacccaactgaggcagagctccaggacatgatcaatgaagtggatgctgatgggaatggtaccattgacttccctgagttcctaaatctcatggccaggaagatgaaggacactgattctgaggaggagctgaaagaggcattccgggttttcgacaaggaccagaatgggttcatctctgctgctgagctccgccatgtgatgaccaacctcggggagaagctcaccgatgaagaggttgatgagatgattcgcgaggccgatgttgatggcgatggccaaataaactacgaggagttcgttaaggtgatgatggccaagtga

SEQ ID NO: 808 - protein, 149 aa, Glycine max
MADQLTDEQISEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 809 - DNA, 1281 bp, Glycine max
  CDS (1)..(1281)
atggatccacaaaaccaacacccccctaacccgagaagcattatcttcaacaagtacgagatggggcgggtcctggggcaaggaaacttcgccaaagtctaccacgcccgaaacctcaacaccaacgagagcgtcgccatcaaagtcatcaagaaagagaagctcaagaaagagcgactcgtgaagcagatcaagcgcgaggtgtcggtgatgagactcgtccgccatccccacatcgttgaactcaaggaagtcatggccacaaagggaaaaatcttcctcgtcatggaatacgttaaaggcggtgaactcttcgccaaagtcaacaaaggaaaactcaccgaagatctcgccagaaagtacttccaacaactcatcagcgccgtcgacttctgtcacagccgcggcgtcacccaccgcgacctcaagccggagaatctcctcttagaccaaaacgaagacctcaaagtctccgacttcggactctccacgctgccggagcagcgtcgcgccgacggcatgctcgtaaccccgtgtgggacccctgcttacgttgcacccgaggtcttaaagaaaaaaggttacgacggttcaaaggccgatttatggtcctgtggggtaatcctcttcgctttgctttgtggctatttacccttccaaggtgagaacgttatgagaatttaccgaaaggctttcagagctgaatatgaattcccagaatggatttctccgcaggccaagaatcttatttcgaatctcctcgttgctgatcctggcaagaggtattccattcctgatataatgagggatccttggtttcaagttgggttcatgaggccaatcgcgttttctattaaggagtcttacgttgaagacaacattgatttcgacgatgtggagaacaaccaggaggaggaggttacaatgaggaaacctgccaggccgttttacaacgcgttcgagataatatcgtccttgtcgcacggctttgatcttaggagtttgtttgagacgaggaagcggtcgccgtcgatgttcatatgcaagttttcggcttcggcggtgttggcgaaggtggaggcggtggcgaagaagctgaactttagggtgacggggaagaaggagtttgtggtgaggatgcaggggacggaggaggggaggaaggggaagctggcgatgacggtggaggttttcgaggggcgccggaggtggcggtggcggagtttactaagtctgccggagatacgttggagtatgttaagttctgtgaggagcaagtga

SEQ ID NO: 810 - protein, 426 aa, Glycine max
MDPQNQHPPNPRSIIFNKYEMGRVLGQGNFAKVYHARNLNTNESVAIKVIKKEKLKKERLVKQIKREVSVMRLVRHPHIVELKEVMATKGKIFLVMEYVKGGELFAKVNKGKLTEDLARKYFQQLISAVDFCHSRGVTHRDLKPENLLLDQNEDLKVSDFGLSTLPEQRRADGMLVTPCGTPAYVAPEVLKKKGYDGSKADLWSCGVILFALLCGYLPFQGENVMRIYRKAFRAEYEFPEWISPQAKNLISNLLVADPGKRYSIPDIMRDPWFQVGFMRPIAFSIKESYVEDNIDFDDVENNQEEEVTMRKPARPFYNAFEIISSLSHGFDLRSLFETRKRSPSMFICKFSASAVLAKVEAVAKKLNFRVTGKKEFVVRMQGTEEGRKGKLAMTVEVFEGRRRWRWRSLLSLPEIRWSMLSSVRSK

SEQ ID NO: 811 - DNA, 1557 bp, Oryza sativa
  CDS (1)..(1557)
atgggcaaccgcacgtcgcgccaccaccgcgccgctcccgagcagccgccgccccagcccaagccgaagcctcagccgcagcagcagcagcagcagtggccgaggccgcagcagccgaccccgccgccggcggcggcgccggacgcggcgatggggagggtgctggggcggccgatggaggacgtccgcgcgacctacaccttcgggcgcgagctcgggcggggccagttcggggtcacctacctcgtcacccacaaggccacggggaagcgcttcgcctgcaagtccatcgccacgcggaagctcgcccaccgcgacgacatcgaggacgtgcgccgggaggtgcagatcatgcaccacctcacgggccaccgcaacatcgtcgagctccggggcgcctacgaggaccgccactcggtcaacctcatcatggagctctgcgagggcggggagctcttcgaccgcatcatcgccagggggcactactccgagcgcgccgccgccgcgctctgccgcgagatcgtcgccgtcgtgcacagctgccactccatgggggtcttccaccgggatctcaagccggagaactttttgttcctcagtaaaagcgaggactcgccgctcaaggccactgacttcggtctttccgttttcttcaagcctggggagcattttaaggaccttgttggaagtgcgtattatgttgcacctgaggtgctgaaacgaaactatggagcagaggctgacatatggagtgctggcgttattctttacatccttctttctggtgttccacctttttgggcagagagtgaagatggtatatttgatgccgtattacgtggtcacattgatttctcgtctgaaccttggccttcgatatccaatggtgcaaaagatttggttaagaagatgttgcggcaagacccaaaagagcgccttacttctgctgaaattttgaaccacccatggattagagaggatggagaagccccagacaagccacttgacattacagttatcagcaggatgaagcagttcagggcaatgaacaagcttaagaaagttgcattgaaggttgttgcagagaacttgtcagatgaagagattacaggcttaaaagaaatgttcagatccttggatactgataacagtgggacaataactcttgaggagctaagatctggtttaccaaaacttggcaccaaaatttctgaatcagaaattagacagctgatggaggcggctgatgttgatggaaatggaaccattgactatgctgagttcatatcagcgacaatgcacatgaacagattggagaaggaagaccacatacttaaagcatttgagtattttgataaggaccacagcggatacataacagtagatgagttggaagaagctctgaagaagtatgatatgggggacgataaaacgattaaggaaatcatcgctgaagtagatactgatcatgatggaagaattaactaccaggagtttgtcgccatgatgaggaacaacaaccctgagattgctcccaaccggcggcgcatgttctaa

SEQ ID NO: 812 - protein, 518 aa, Oryza sativa
MGNRTSRHHRAAPEQPPPQPKPKPQPQQQQQQWPRPQQPTPPPAAAPDAAMGRVLGRPMEDVRATYTFGRELGRGQFGVTYLVTHKATGKRFACKSIATRKLAHRDDIEDVRREVQIMHHLTGHRNIVELRGAYEDRHSVNLIMELCEGGELFDRIIARGHYSERAAAALCREIVAVVHSCHSMGVFHRDLKPENFLFLSKSEDSPLKATDFGLSVFFKPGEHFKDLVGSAYYVAPEVLKRNYGAEADIWSAGVILYILLSGVPPFWAESEDGIFDAVLRGHIDFSSEPWPSISNGAKDLVKKMLRQDPKERLTSAEILNHPWIREDGEAPDKPLDITVISRMKQFRAMNKLKKVALKVVAENLSDEEITGLKEMFRSLDTDNSGTITLEELRSGLPKLGTKISESEIRQLMEAADVDGNGTIDYAEFISATMHMNRLEKEDHILKAFEYFDKDHSGYITVDELEEALKKYDMGDDKTIKEIIAEVDTDHDGRINYQEFVAMMRNNNPEIAPNRRRMF

SEQ ID NO: 813 - DNA, 1593 bp, Brassica napus
  CDS (1)..(1593)
atggacgatccgacgaccccttctccatacgatcttctctttgaaggtctctggctcatcccaattcgtcactatctctacgctctcatcctcatctggaccgtattcttctacaatttcgtggagttccatttccttggtgatgcggttcttcagtatttcagaggtcgagtgaatctcatctacaacccagattctcctatttaccacggtgttgtctctcgctgccggactcttcacggccggtatgtggcgacaccgtggttagcgagtcctcatcttcagacttgtttccttaatttccatggattgcctcccgttttcacctacacaagaaagctctttcgtgcttctgatggtggaaccattgctctcgattggcttaccaactcccatgttgatgatgcagatcctcacaatcagaatgaaatcagtaaagaagacacaactcctattgctgttgttattccagggctaactagtgattcttcttctgcatatctaaagcaccttgcctataacactgcaaaatccggttggaatgttgttataagcaaccatagaggactgggtggtatttctgtcacttccgattgcttctataatgctggatggacagaggatgtacgggtagttcttgatcatcttcaacacgagttccctatggctcctctctttgctattggaactagcattggcgctaatattctggtgaaataccttggggaagagggtgagaagactcctctgaggggcggtgttgctatttgctctccatgggacctcttgattggtgacaggtttatctcccgaaaattcaaacaaaggttgtacgacagagctctaaccatcggacttcaaggttatgcccaattacatgaacctcagtatacacggcttgctaattgggaaggcataaaaaagtcacgttccatccgagattttgacaatcatgctacatgtcatgtcgggaaatttgagactgtggatacgttttaccgaaaatctagcagtacccaatacgtaggaaacgtggcggtgccgctactctgtatcagtgctctagatgatcccttatgcacaaaggaagctatcccttgggaagaatgccgggcaaacaaaaacattgtcttggtgacaacaaatcacgggggacatctagcttttttcgaaggattaactgcatctagcttgtggtgggttcgggccaccaacgagtttcttggcgcccttagctgcagtcgctatatgcatacacagaaaattcaagagagtggaagctcaggatcaagaaagcaggaggaaccttcaataaaccaaggcccgtacctgaacattggagaagacgggttggtagcagcagtcaacttggaggaaaacaccacacggtcaaaagatgcaacacaagtattgaaacagagaggaccaaaggttaaagataagagaagctttaacgtgttgtgccgccagacaaaacggtccatatggttgcttggttacataggcatggtaacaggtttccctttagttgggatgctcatgaactacctctttcgtaagaagcaacgacccataacagcctccaagtcctga

SEQ ID NO: 814 - protein, 530 aa, Brassica napus
MDDPTTPSPYDLLFEGLWLIPIRHYLYALILIWTVFFYNFVEFHFLGDAVLQYFRGRVNLIYNPDSPIYHGVVSRCRTLHGRYVATPWLASPHLQTCFLNFHGLPPVFTYTRKLFRASDGGTIALDWLTNSHVDDADPHNQNEISKEDTTPIAVVIPGLTSDSSSAYLKHLAYNTAKSGWNVVISNHRGLGGISVTSDCFYNAGWTEDVRVVLDHLQHEFPMAPLFAIGTSIGANILVKYLGEEGEKTPLRGGVAICSPWDLLIGDRFISRKFKQRLYDRALTIGLQGYAQLHEPQYTRLANWEGIKKSRSIRDFDNHATCHVGKFETVDTFYRKSSSTQYVGNVAVPLLCISALDDPLCTKEAIPWEECRANKNIVLVTTNHGGHLAFFEGLTASSLWWVRATNEFLGALSCSRYMHTQKIQESGSSGSRKQEEPSINQGPYLNIGEDGLVAAVNLEENTTRSKDATQVLKQRGPKVKDKRSFNVLCRQTKRSIWLLGYIGMVTGFPLVGMLMNYLFRKKQRPITASKS

SEQ ID NO: 815 - DNA, 1314 bp, Glycine max
  CDS (1)..(1314)
atggtgattttaaaccttgggagaaatgaggggcagggaatgcggcttgggaaatacgagttgggaaagacacttggagaaggcaattttggaaaagtcaagttggcaagggacactcattctggcaaactttttgctgttaagatccttgacaagagcaagatcattgacctcaataacactgatcagataaagagggaaatattcaccttgaagctgctgaagcatccgaacgttgttagattatacgaggtcttggctagcaaaaccaaaatttatatggtacttgagtatgtgaatggaggagagttatttgacaaaattgcatccaaaggtaaactaaaagaagctgtaggtaggaagatattccaacagttgattgattgtgtaagcttctgccacaataaaggtgtcttccacagggatctcaagctggagaatgtacttgtggatgccaaagggaacataaagataaccgattttaaccttagtgctttaccccagcattttagggcagatgggttgctacatacaacatgtggaagtcccaactatgttgcccctgagattcttgccaataaaggctatgatggtgcaacatcagatatatggtcatgtggtgttatcttgtatgtaattctaacaggataccttccttttgatgacagaaatctcgcagttctctatcaaaagattcttaaaggagaagttcagataccaagatggctatcacctggttctcaaaacattataaagagaatgcttgatgtcaatcttaaaacccggataacaatggctatgatcaaagaagatgaatggttcaaggagggttatagtcctgcaaatccagaagatgaggaagagagtgtgtatattgatgaagacttttccatccatgatgtgtcacttgaagcagatcaagggagtccaagatcaccaacactaatcaatgcatttcagttgatatcaatgtcttcaagtctagacctctctggtttttttgagcaagaggatgtttctgagaggaaaataagatttacatccatccattcaccaaaagatttagttgagaggcttgaagacattgtaactgaaatgggattcagagtccagaagaaaaatgggatgttgaaagtggtgcaagagatcaaaacacagaaatgtcttggtaacctctcagtggcagcagaggtgtttgaaataagtccatccctatatgtagtagagttaagtaagtcatgtggagatgcttctgtatatagacagctatgcaagaagctatctaatgatttgggtgttcacaaaaaggaatag

SEQ ID NO: 816 - protein, 437 aa, Glycine max
MVILNLGRNEGQGMRLGKYELGKTLGEGNFGKVKLARDTHSGKLFAVKILDKSKIIDLNNTDQIKREIFTLKLLKHPNVVRLYEVLASKTKIYMVLEYVNGGELFDKIASKGKLKEAVGRKIFQQLIDCVSFCHNKGVFHRDLKLENVLVDAKGNIKITDFNLSALPQHFRADGLLHTTCGSPNYVAPEILANKGYDGATSDIWSCGVILYVILTGYLPFDDRNLAVLYQKILKGEVQIPRWLSPGSQNIIKRMLDVNLKTRITMAMIKEDEWFKEGYSPANPEDEEESVYIDEDFSIHDVSLEADQGSPRSPTLINAFQLISMSSSLDLSGFFEQEDVSERKIRFTSIHSPKDLVERLEDIVTEMGFRVQKKNGMLKVVQEIKTQKCLGNLSVAAEVFEISPSLYVVELSKSCGDASVYRQLCKKLSNDLGVHKKE

SEQ ID NO: 817 - DNA, 450 bp, Brassica napus
  CDS (1)..(450)
atggcggatcagctaacggacgaacagatctccgagttcaaggaagctttcagcctcttcgacaaggacggcgatggttgcatcaccaccaaggagctggggacagtgatgcggtccctaggacagaacccaacagaagctgagctccaggacatgatcaacgaggtggacgcggacggcaacggcaccattgacttccctgagttcctaaacctcatggctaaaaagatgaaagacacggactcggaggaagagctcaaagaagctttcagggtgttcgacaaagaccagaacggattcatatccgctgcagagctccgccatgtcatgacgaatctaggcgagaagcttactgatgaagaagttgaggagatggtccgtgaagctgatgttgatggagatggtcagattaactacgaggagtttgtcaagattatgatggctaagtga

SEQ ID NO: 818 - protein, 149 aa, Brassica napus
MADQLTDEQISEFKEAFSLFDKDGDGCITTKELGTVMRSLGQNPTEAELQDMINEVDADGNGTIDFPEFLNLMAKKMKDTDSEEELKEAFRVFDKDQNGFISAAELRHVMTNLGEKLTDEEVEEMVREADVDGDGQINYEEFVKIMMAK

SEQ ID NO: 819 - DNA, 510 bp, Glycine max
  CDS (1)..(510)
atgaagactgcaaagggcaagggagcagcgaggccctcaaaagaatcactgaagcctgttgatgaccgaaaggttggaaagcggaaggcttctggtaagcctgagaaaagcagagcaccaaagaaggagaagaaggccaagaaagaccccaacaagcctaaaagaccaccgagtgctttcttcgtgttccttgaggagttcaggaagacctttaaggctgagaatcctctcgtgaaggctgtatcagttgttggaaaagctggaggagagaaatggaaatccctgtccagtgctgagaaagctccatatgaagccaaggctgcaaaaaggaaagctgagtatgaaaaacttatcaaagcttatgagaaaaagcaggcaagctctgcagatgatgatgaatcagacaagtccaaatctgaagtgaatgatgaagatgatgccagtggagaggaggaccaccaagaggacgaggatgatgaggaggaagaggacgatgaagatgatgactga

SEQ ID NO: 820 - protein, 169 aa, Glycine max
MKTAKGKGAARPSKESLKPVDDRKVGKRKASGKPEKSRAPKKEKKAKKDPNKPKRPPSAFFVFLEEFRKTFKAENPLVKAVSVVGKAGGEKWKSLSSAEKAPYEAKAAKRKAEYEKLIKAYEKKQASSADDDESDKSKSEVNDEDDASGEEDHQEDEDDEEEEDDEDDD

SEQ ID NO: 821 - DNA, 1353 bp, Brassica napus
  CDS (1)..(1353)
atgcgtgagatccttcacatccagggaggccagtgcggtaaccagatcggtgccaagttctgggaagtcgtctgcgccgagcacggcatcgatcccaccggtcgatacaccggagactcagatctgcagctcgagcgcatcaacgtctactacaatgaagcaagctgcgggagattcgtccctcgcgccgtcctcatggatctggagcctggaaccatggacagtctcagatctggaccttacggtcaaaccttccgccccgataacttcgtcttcggccaatcaggagccggtaacaactgggccaaggggcactacactgaaggagctgagctaatcgattcagtgctcgatgttgttcgtaaggaggctgagaactgtgactgtcttcaagggtttcaggtttgccattccttgggaggaggaactggatctggtatgggaacgcttctgatctctaagatccgtgaagagtacccagatcggatgatgcttaccttctcagtgtttccttccccaaaggtctctgacaccgtcgttgagccttacaacgctacgctgtctgttcatcagctggttgagaacgctgatgagtgtatggttcttgacaacgaggccttgtatgatatctgcttcaggactctcaaactcactacccctagctttggtgatttgaaccacttgatatctgccaccatgtctggtgtgacttgctgtttgaggttccctggtcagctcaactctgacctccgcaagcccgctgtgaacctgatcccatttccacgtcttcacttcttcatggtgggttttgctcccctcacctcaagaggatctcagcagtaccgttccctcacagtccctgagctcacccagcagatgtgggactccaagaacatgatgtgtgctgcagacccaagacacggtcgctacctcacagcctccgccatgttccgtggcaagatgagcacaaaggaagtggacgagcagatgctgaacgtgcagaacaagaactcatcctactttgtggagtggatcccaaacaacgtgaagtcaacagtctgtgacatcccgccaactggtctgaagatggcgtcaactttcattggaaactcgacttcgatccaggagatgtttaggcgtgtgagtgagcagttcacggctatgttcaggaggaaggctttcttgcattggtacacaggggaaggaatggacgagatggagtttacggaagcggagagcaacatgaacgatctggtttcggagtaccagcaataccaagatgcaacggcagatgaagaaggtgagtacgaggatgaggaagaaggagaataccaacaagaggaagagtactga

SEQ ID NO: 822 - protein, 450 aa, Brassica napus
MREILHIQGGQCGNQIGAKFWEVVCAEHGIDPTGRYTGDSDLQLERINVYYNEASCGRFVPRAVLMDLEPGTMDSLRSGPYGQTFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKPAVNLIPFPRLHFFMVGFAPLTSRGSQQYRSLTVPELTQQMWDSKNMMCAADPRHGRYLTASAMFRGKMSTKEVDEQMLNVQNKNSSYFVEWIPNNVKSTVCDIPPTGLKMASTFIGNSTSIQEMFRRVSEQFTAMFRRKAFLHWYTGEGMDEMEFTEAESNMNDLVSEYQQYQDATADEEGEYEDEEEGEYQQEEEY

SEQ ID NO: 823 - DNA, 429 bp, Zea mays
  CDS (1)..(429)
atgatccggttcatcctgctgcagaaccggcaggggaaaacacggctggccaagtactatgtcgctctcgaggactccgagaagcacaaggttgagtacgaggtgcatcggctcgtggtcaaccgggaccccaagttcaccaacttcgtcgagttccgcacgcacaaagttatatataggagatatgcaggactttttttctctatatgtgtggacatcaccgacaacgaattggcatacttggaatgtatccatctgtttgttgagatattggaccatttcttcagcaatgtgtgtgaacttgatttagtatttaatttccacaaggtttacttgatattggatgagttcattcttgctggagagcttcaagaaacaagcaaaagggcaattatagagaggatgggcgagcttgagaagctggaatga

SEQ ID NO: 824 - protein, 142 aa, Zea mays
MIRFILLQNRQGKTRLAKYYVALEDSEKHKVEYEVHRLVVNRDPKFTNFVEFRTHKVIYRRYAGLFFSICVDITDNELAYLECIHLFVEILDHFFSNVCELDLVFNFHKVYLILDEFILAGELQETSKRAIIERMGELEKLE

SEQ ID NO: 825 - DNA, 411 bp, Glycine max
  CDS (1)..(411)
atggcccgtacaaagcaaactgctcgtaagtcaactggaggaaaagctcccaggaagcagcttgcaaccaaggctgcacgtaagtctgctccaacaactggtggtgtgaagaagcctcatcgttatcgccctggaactgttgctcttcgtgagattaggaaataccagaagagcactgagctcctaatcaggaagcttcctttccagaggttggttcgtgaaattgcccaggatttcaagactgatctgcgtttccagagccatgctgtgcttgcattgcaagaggctgctgaggcataccttgttgggctctttgaggacactaacttgtgtgccattcacgccaagcgtgtgactattatgcccaaggatattcagctggcaagaaggattcgtggtgagcgtgcttga

SEQ ID NO: 826 - protein, 136 aa, Glycine max
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 827 - DNA, 1368 bp, Brassica napus
  CDS (1)..(1368)
atggatcttgtgattggtgggaaattcaaacttggcagaaaaattggcagtggatcatttggagagctctatcttggtgtaaatgtccaaaccggagaagaagttgctgttaagctggaatctgtcaagaccaagcatcctcagctacactatgagtccaaattgtatacgttgcttcaaggaggaagtggtattcctaacatcaagtggtatggagttgatggagaatacaatgttatggttattgaccttctaggtccaagtcttgaagacttgttcaactactgcaaccgaaaactctctttgaaaaccgttctcatgcttgctgatcaacttattaacagagttgagtatatgcacactagaggtttccttcaccgtgatattaagcctgacaacttcttaatgggcctcggccgcaaagcaaaccaggtttatataattgattttggattggggaagaaatacagagaccttcagactcacaggcacattccttacagagaaaacaaaaacctcactggaacagctcggtatgcaagtgtcaacacacaccttggagtagaacaaagtcgaagggacgatttggaagcagttggttatgtgcttatgtacttcctcaaaggaagcttaccatggcagggattaaaagctgggacaaggaagcagaagtatgacagaataagtgagaagaaagtctcaactcctatagaggtcttatgtagaaaccaaccgtctgagtttgtttcttacttccgctactgccggtctctacggtttgatgacaaacctgattactcttacctcaagaggctattccgagacttgtttattagagaaggttatcagtttgattatgtatttgactggaccgtcttgaagcatccgcaaactggttccagctccagttctagttcaagaacacgggatcatacaactggaaaaccggagttaactgctggaaaaccggagaggactgctggcaataggttatcaggtgcggttgaagctttttcaagaaggcatgcaacaccacgtgatcggtctgcatcaagaaactctgatgatgtccctgttggtggtggtgagtcagaaagaagaggcagttcgtcaagaaacggaagctcttcaaggagagcaatcgcctcgagctcacgtccaagttcagctgggggtcctagtgatagcagatcctctagccgtttggtgacttcaagcggcggtggtggaatgggatcaacgagccagagaatgggaccaggaggatatgagtcaaagaagagttcgactctttcccgtggtgctagaaacactcggggagatccgttaaggaggagcttcgagcttctttctcttcgtaaatcatga

SEQ ID NO: 828 - protein, 455 aa, Brassica napus
MDLVIGGKFKLGRKIGSGSFGELYLGVNVQTGEEVAVKLESVKTKHPQLHYESKLYTLLQGGSGIPNIKWYGVDGEYNVMVIDLLGPSLEDLFNYCNRKLSLKTVLMLADQLINRVEYMHTRGFLHRDIKPDNFLMGLGRKANQVYIIDFGLGKKYRDLQTHRHIPYRENKNLTGTARYASVNTHLGVEQSRRDDLEAVGYVLMYFLKGSLPWQGLKAGTRKQKYDRISEKKVSTPIEVLCRNQPSEFVSYFRYCRSLRFDDKPDYSYLKRLFRDLFIREGYQFDYVFDWTVLKHPQTGSSSSSSSRTRDHTTGKPELTAGKPERTAGNRLSGAVEAFSRRHATPRDRSASRNSDDVPVGGGESERRGSSSRNGSSSRRAIASSSRPSSAGGPSDSRSSSRLVTSSGGGGMGSTSQRMGPGGYESKKSSTLSRGARNTRGDPLRRSFELLSLRKS

SEQ ID NO: 829 - DNA, 429 bp, Oryza sativa
  CDS (1)..(429)
atgatccggttcatcctgctgcagaatcggcaggggaagacgcggctggccaagtactacgtcccgctcgaggactcggagaagcacaaggtcgagtacgaggtgcatcggctggtggtcaaccgggatcccaagttcaccaacttcgttgagttccggacgcataaagttatatacaggcgatatgcaggactgtttttctcaatgtgtgtggatatcactgacaatgagttggcatacttggaatgcatccacttgtttgtcgagatattagatcatttcttcagcaatgtgtgtgaactcgacttagtatttaatttccacaaggtttatttgatattggatgagtttattctcgctggagaacttcaagagacaagcaaaagggcaataatagagcgaatgggtgagcttgagaagctggaataa

SEQ ID NO: 830 - protein, 142 aa, Oryza sativa
MIRFILLQNRQGKTRLAKYYVPLEDSEKHKVEYEVHRLVVNRDPKFTNFVEFRTHKVIYRRYAGLFFSMCVDITDNELAYLECIHLFVEILDHFFSNVCELDLVFNFHKVYLILDEFILAGELQETSKRAIIERMGELEKLE

SEQ ID NO: 831 - DNA, 450 bp, Oryza sativa; identical to SEQ ID NO: 807
  CDS (1)..(450)

SEQ ID NO: 832 - protein, 149 aa, Oryza sativa; identical to SEQ ID NO: 808

SEQ ID NO: 833 - DNA, 1272 bp, Glycine max
  CDS (1)..(1272)
atggaacgcatcgttggcggcaagtacaagctcggccgcaagatcggaagtggatccttcggcgaaatctacctcgcgacgcatattgataccttcgagatcgtcgccgtcaagatcgagaatagtaaaacaaaacatccacaactgctttacgaggcaaagctatacaatattcttcaaggaggaagtggcattccgaacataaaatggtctggcatagacggggaggataatgtgcttgttattgatttgcttgggccgagtcttgaggatctctttgtgtattgtggaaggaagttttcattgaagacagtattaatgttggctgatcaaatgatcactagaatagaatatgtgcattctaaaggatttttacacagggatattaaacctgataactttctcatgggacttggtcgaaaggccaaccaggtttacataattgattttgggcttgcaaaacgatatcgggattccactaccaatcgccacatcccttacagggagaacaaaaacttaacgggtactgctcgatatgcaagttgcaatactcatcttgggattgagcaaagtcgccgggatgatttggaatcactaggatatgtacttctgtacttcctaagaggaagccttccttggcaaggtctaaaggcggctacaaagaaacagaagtatgataaaatatgccagaagaaattatcaactcctattgaggtactatgcaaatctcatcctgtagagtttgcttcgtacttccattactgccactctttgacatttgatcaacgacctgattatggtttcttgaagcgcctatttcgggacctatttgctcgtgatggttatgattttgattacgtttttgattggaccattttgaagtaccagcaatctcaaaagaatccagttccaggagcaagtaacagtcgtgcaattccaatggatattgacaatcatcaaggtcttaattcatattcagggcatgttaaagagcgtattagagctggtgatgctactggttctggtgttaaaattcagtttaaatcaccagtgggtaaaaatttgagttatgagaaaccacttgacaaaaatatttttggagaagcaaatattccctctacttcattttctcctgctagtacttcacaaaggaactccttgaagcaatccttgtctgctgaagcttccaaccctggacatgcacaaggcagtaaaattggcccttcaagtagcttgatgtcatctctgcagcacatgtcttctgctaaatga

SEQ ID NO: 834 - protein, 423 aa, Glycine max
MERIVGGKYKLGRKIGSGSFGEIYLATHIDTFEIVAVKIENSKTKHPQLLYEAKLYNILQGGSGIPNIKWSGIDGEDNVLVIDLLGPSLEDLFVYCGRKFSLKTVLMLADQMITRIEYVHSKGFLHRDIKPDNFLMGLGRKANQVYIIDFGLAKRYRDSTTNRHIPYRENKNLTGTARYASCNTHLGIEQSRRDDLESLGYVLLYFLRGSLPWQGLKAATKKQKYDKICQKKLSTPIEVLCKSHPVEFASYFHYCHSLTFDQRPDYGFLKRLFRDLFARDGYDFDYVFDWTILKYQQSQKNPVPGASNSRAIPMDIDNHQGLNSYSGHVKERIRAGDATGSGVKIQFKSPVGKNLSYEKPLDKNIFGEANIPSTSFSPASTSQRNSLKQSLSAEASNPGHAQGSKIGPSSSLMSSLQHMSSAK

SEQ ID NO: 835 - DNA, 1398 bp, Brassica napus
  CDS (1)..(1398)
atggagccgcgagtcggaaacaagtttcggctggggcggaagatcggaagtggatcattcggagagatctatcttggtactgatatacagactaatgaagaagttgccattaaactcgaaaatgtgaaaactaagcatcctcagttactgtatgaatcaaaattatataaagtattacaaggaggaaccggcgttccaaacattaaatggtatggtgttgaaggggaatataacgtccttgtgatagacttgtttgggcctagccttgaagatctattcaatttctgtagtaggaaactctcactaaagactgtactgatgcttgccgatcaaatgatcaatcgcattgaatttgttcatcagaggtcatttctacaccgggacatcaagcctgacaactttctgatgggtctcgggaggcgcgcaaatcaggtatacatcatcgactttggtctagcgaagaagtacagagactcgaatcatcagcatattccgtacagggaaaacaaaaacttaactggaactgctagatacgccagcatgaacactcaccttggcattgaacaaagccgtagggatgatttggagtcacttggatttgttctcatgtactttttaaaaggaagtcttccttggcaaggactgaaagctggtaataagaagcaaaagtatgagaggattagtgaaaagaaagtatcgacatctattgagtctttatgccgaggatatccatctgaatttgcttcttacttccattattgccggtccctgagattcgatgacaagccagactatgcctacctgaaacggcttttccgtgacctgtttattcgcgaaggcttccagtttgattatgtatttgactggactatcttgaagtatcagcaatcacagctttctactcctccccgtcccaatgtccctggagttgggcaaagctctggccttccccctgctattgctagtgctgagaggccatcaggtggcgaggaagctagaacttctggctggccatcaggaaacgctaggcggatttctggacaaatatttaattcaggcaacttagctaaacaaaaagcaccagtttcaagtgatcctgcaatctctaaaaatgtaatgttatctagctctagctttctccgcgcaactgggtcatcaagacgtgctgctgtctccggtagtcgcgaggctgcagttcctggaactgattctgagccatcaaaccctcaaatcattgaagctggaacaagctccaacccaaagattcatggtggtcgaagctcacctatagtctcatctgagaacaagaagctatcatctccatcaaggggaaatacttcagttatgaagaactatgagtccaatcttaataaagggatcgagggtctgcacttttag

SEQ ID NO: 836 - protein, 465 aa, Brassica napus
MEPRVGNKFRLGRKIGSGSFGEIYLGTDIQTNEEVAIKLENVKTKHPQLLYESKLYKVLQGGTGVPNIKWYGVEGEYNVLVIDLFGPSLEDLFNFCSRKLSLKTVLMLADQMINRIEFVHQRSFLHRDIKPDNFLMGLGRRANQVYIIDFGLAKKYRDSNHQHIPYRENKNLTGTARYASMNTHLGIEQSRRDDLESLGFVLMYFLKGSLPWQGLKAGNKKQKYERISEKKVSTSIESLCRGYPSEFASYFHYCRSLRFDDKPDYAYLKRLFRDLFIREGFQFDYVFDWTILKYQQSQLSTPPRPNVPGVGQSSGLPPAIASAERPSGGEEARTSGWPSGNARRISGQIFNSGNLAKQKAPVSSDPAISKNVMLSSSSFLRATGSSRRAAVSGSREAAVPGTDSEPSNPQIIEAGTSSNPKIHGGRSSPIVSSENKKLSSPSRGNTSVMKNYESNLNKGIEGLHF

SEQ ID NO: 837 - DNA, 450 bp, Glycine max
  CDS (1)..(450)
atggccgaccagctcaccgacgaccagatcgccgagttcaaggaggccttcagcctcttcgacaaggacggcgatggttgcattactaccaaggaacttgggactgttatgaggtcacttggtcaaaacccaactgaggcagaactgcaggatatgataaacgaggttgatgctgatggcaacggaaccatcgatttcccagagttcctcaacctgatggctcgcaagatgaaagacaccgactcagaggaggagcttaaggaggctttccgtgtgtttgacaaggatcagaatggtttcatctctgcagctgagctccgccatgtcatgacaaatcttggggagaagctgacggacgaggaggtggatgagatgatccgtgaggccgatgttgacggtgatggacagatcaactatgaggagtttgtcaaagtcatgatggccaagtga

SEQ ID NO: 838 - protein, 149 aa, Glycine max
MADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 839 - DNA, 1089 bp, Glycine max
  CDS (1)..(1089)
atgcagaaaacttctggaaatattataggccattttcttggaggtttatattattatctaagaagatgcatgtttgccattttatctgtgggtcctgtgccaagtcatattgctttcatcatggatgggaatcgaaggtatgcaaagaagagaaacatggaagaaggtgatggccataaggctggatttactgctctcatgtccatccttagatactgttatgaattgggagtgaagtatgtcactgtctatgcattcagcattgataacttcaaaaggaagcctaacgaggttcagtccttgatggaattgatgcgggaaaagattgaagagttacttctacaagaaagtcttatcaatgaatacggtgttagattacatttcattggagacttgcaactattgactgagcctgtcagggcttctgtggaaaaagcaatgagagttactgctcacaacaaccagagagttcttttgatttgcgtagcctatacttctcgtcacgagattgtgcatgccgttcaagaatgctgcaaggaaaaatggaatgaagttcaagcatcaaaagaagcaaagctaacaaatggtgcatttgcaagaattgatcagggcctgaaaggaaatggttttgatttgctttttcaagattcaagtaaagactatcaaaatgtaaccaaagcttgtagcagtgtacctaaaggagtgcaaggtgctggagagaaagatggcatgttggagcataccgtagagaaacatagcgaaaacaatagtgaagctgaaatcacattatgcaatgaactgtttgaaatgactgaagagaggaagtataagcagggtgatgttcctttaataaaactggtggatattgagaagcacatgtacatggcagtggcacctgacccagacatcttgatccgaacttctggagaggctcgactcagcaattttcttctttggcagactagtacctgccctttgtatgcgccaactgcactttggcctgaaataggcctaagacacttggtctgggcagtattgaattttcagagacaccatttttatttggaaaagaaaaagaaacagttttaa

SEQ ID NO: 840 - protein, 362 aa, Glycine max
MQKTSGNIIGHFLGGLYYYLRRCMFAILSVGPVPSHIAFIMDGNRRYAKKRNMEEGDGHKAGFTALMSILRYCYELGVKYVTVYAFSIDNFKRKPNEVQSLMELMREKIEELLLQESLINEYGVRLHFIGDLQLLTEPVRASVEKAMRVTAHNNQRVLLICVAYTSRHEIVHAVQECCKEKWNEVQASKEAKLTNGAFARIDQGLKGNGFDLLFQDSSKDYQNVTKACSSVPKGVQGAGEKDGMLEHTVEKHSENNSEAEITLCNELFEMTEERKYKQGDVPLIKLVDIEKHMYMAVAPDPDILIRTSGEARLSNFLLWQTSTCPLYAPTALWPEIGLRHLVWAVLNFQRHHFYLEKKKKQF

SEQ ID NO: 841 - DNA, 606 bp, Brassica napus
  CDS (1)..(606)
atgagcacagcgagattcatcaagtgtgtgacggtcggagatggagctgtggggaagacttgtatgctgatttcatataccagcaatacttttcctacggattacgttccgacagtttttgacaatttcagtgcgaatgtggtggtcgatggaagtactgtcaacctcggcctgtgggatactgctgggcaggaagattataacaggcttcggcctttgagttacagaggagcagatgtgtttttattggcattttccctaattagcaaggccagttacgagaacatttacaaaaagtggcttccggagctgaaacattatgcgcctagcatccccattgtactcgtcggaaccaagttagatttgagggatgacaaacagttcttgaaagatcatccaggagcagcttcaataacaactgcccagggagaggaattaagaaagatgattggagccatcaagtacttagaatgcagctccaaaacccagcagaatgtgaaggcagtgtttgatacagcgatccgggtagcgttgaggcctccaaaggcaaagaagaagataaagccattgaggaccaaaagatcaagaacatgctttttcttctaa

SEQ ID NO: 842 - protein, 201 aa, Brassica napus
MSTARFIKCVTVGDGAVGKTCMLISYTSNTFPTDYVPTVFDNFSANVVVDGSTVNLGLWDTAGQEDYNRLRPLSYRGADVFLLAFSLISKASYENIYKKWLPELKHYAPSIPIVLVGTKLDLRDDKQFLKDHPGAASITTAQGEELRKMIGAIKYLECSSKTQQNVKAVFDTAIRVALRPPKAKKKIKPLRTKRSRTCFFF

SEQ ID NO: 843 - DNA, 429 bp, Glycine max
  CDS (1)..(429)
atgatccgattcattctgttgcagaacaggcagggcaagacccgtcttgccaaatactacgttcctctcgaggattccgagaagcacaaggtggaatacgaggttcaccgcctcgtcgtaaacagagaccctaaatacacaaatttcgtcgagtttcgtacgcacaagataatatacaggcgatatgctgggttgtttttctcaatctgtgttgatatcactgataatgagttggcgtatttagagtgcatccatttgtttgtggaaatattggatcacttcttcagcaatgtctgtgagcttgatttggtttttaacttccacaaggtctatcttatacttgatgaattcattctagcgggtgaactgcaagaaacaagcaagaaggctattattgagagaatgggggaactggaaaaactagaatga

SEQ ID NO: 844 - protein, 142 aa, Glycine max
MIRFILLQNRQGKTRLAKYYVPLEDSEKHKVEYEVHRLVVNRDPKYTNFVEFRTHKIIYRRYAGLFFSICVDITDNELAYLECIHLFVEILDHFFSNVCELDLVFNFHKVYLILDEFILAGELQETSKKAIIERMGELEKLE

SEQ ID NO: 845 - DNA, 261 bp, Brassica napus
  CDS (1)..(261)
atgaaaggtggtgaaggcaaagctcaagcgaagagcagtgacgagagattgaagacgagagggaagaaagcagggaagaaagtgaaggatccgaacaagcctaagaggcctccaagtgccttcttcgtcttcctggagggattccgaaaggagttcaatctagctaaccctgacaacaaatccgtcggagctgtaagtagtagtagtagtgccttcatctggagactttttccatatgattcttacttaatcctttactag

SEQ ID NO: 846 - protein, 86 aa, Brassica napus
MKGGEGKAQAKSSDERLKTRGKKAGKKVKDPNKPKRPPSAFFVFLEGFRKEFNLANPDNKSVGAVSSSSSAFIWRLFPYDSYLILY

SEQ ID NO: 847 - DNA, 411 bp, Oryza sativa
  CDS (1)..(411)
atggcccgtacgaagcagaccgcccgcaagtccaccggcggcaaggccccgaggaagcagctcgccaccaaggcggcgaggaagtctgctccgaccaccggcggcgtgaagaagccccaccgctacaggccggggacggtggcgctccgcgagatccgcaagtaccagaagagcacggagctcctgatccgcaagctccccttccagcgcctcgtccgcgagatcgcgcaggacttcaagaccgacctccgcttccagagccacgcggtgctcgccctccaggaggccgccgaggcctacctcgtcggtctcttcgaggacaccaacctctgcgccatccacgccaagcgcgtcaccatcatgcccaaggacatccagctcgcccgccgcatccgcggcgagcgcgcgtaa

SEQ ID NO: 848 - protein, 136 aa, Oryza sativa; identical to SEQ ID NO: 826

SEQ ID NO: 849 - DNA, 792 bp, Brassica napus
  CDS (1)..(792)
atgggcggtgaagttaggcaacttctcgagcagatacacaggttttctaggagatgtttgttcagagtcctatctatgggtcctttgcccacccacctcgcctttatcatggatgggaaccgcaggtacgccaagaagcgcggtctagaagacgggtcaggccacaaagccgggttctccacccttatgtcgatgctgcagtactgctacgagctgggtatcaagtacgtgactatatacgcgttcagcatagataacttcaggaggaagcctgaggaggttcagtctctgatggatttgatgttggaaaagatcaagtctttgcttgataaagagagcatcgtgcacgagtacgggatacgggtttattttataggtaacttggggcttttaaacgaccaagtgagagctgctgcggaggaagtcatgaaggccacggctaagaatagtagagtggtgcttcttgtctgcgttgcttataactcgacggatgagatcgttcaagctgtcaagagatcttgtgtggacaaggcagatagggatacagagaggattcagctggtggatattgaggagaatatgcagatgagcgtggcgccggagcctgatatactgatcaggagttcgggagagacgaggctgagcaactttcttttgtggcaaacaggtaactctcagctcttctctctggatgctctgtggcctgagattggactgaggcatctggtgtgggctatattgaacttccagagaagccattcatacttggagaagaggaagaaacagttgtag

SEQ ID NO: 850 - protein, 263 aa, Brassica napus
MGGEVRQLLEQIHRFSRRCLFRVLSMGPLPTHLAFIMDGNRRYAKKRGLEDGSGHKAGFSTLMSMLQYCYELGIKYVTIYAFSIDNFRRKPEEVQSLMDLMLEKIKSLLDKESIVHEYGIRVYFIGNLGLLNDQVRAAAEEVMKATAKNSRVVLLVCVAYNSTDEIVQAVKRSCVDKADRDTERIQLVDIEENMQMSVAPEPDILIRSSGETRLSNFLLWQTGNSQLFSLDALWPEIGLRHLVWAILNFQRSHSYLEKRKKQL

SEQ ID NO: 851 - DNA, 1347 bp, Brassica napus
  CDS (1)..(1347)
atgagagagatccttcacattcaaggtggtcaatgtgggaaccagattggatccaagttctgggaagttgtttgcgacgagcacgggattgatcccactggtcgttacactggcaactccgatctgcagctggagcgcgtcaatgtttactataacgaggcgtcgtgtggaagatatgttccccgtgctattctcatggatcttgagcctggtactatggacagcgtcagaactggaccttatggtcagatcttcaggcctgacaactttgttttcgggcagtctggtgctggaaacaactgggctaaagggcattacactgaaggagccgagcttattgatgctgtgctcgatgttgtgcgtaaggaggctgagaattgtgactgtcttcagggtttccaagtatgtcactcgcttggtggaggcactggatctggaatgggaacgttgttgatatctaagatcagggaagagtatcctgatcgtatgatgcttactttctccgtcttcccatcacctaaggtctcagacactgtggttgaaccgtacaatgcgacactttcagttcatcagctggttgaaaatgctgatgagtgtatggttttagacaatgaagctctttatgacatctgttttagaactctgaagctcaccactcccagctttggtgatctcaatcatctgatctctgcaaccatgagtggagttacgtgctgtcttaggttccctggtcagctcaactctgatctgaggaagcttgcagtgaacctcatccctttccctcgtctccactttttcatggtcggtttcgctcctctcacctcccgtggctcccagcagtaccgcgcactcaccgtccctgagctcacccaacagatgtgggattcaaagaacatgatgtgtgccgcagacccgcgtcacggacgatacttgactgcctcagcaatgttccgtggcaaaatgagtacaaaagaagtggacgagcagatgataaacgtgcagaacaagaactcatcctactttgtggaatggataccgaacaacgtgaagtcaagcgtctgtgacatagcgcctcgaggcctctcgatggcctcaacctttattgggaactccacatcgatccaagagatgtttaggagggtgagtgagcagttcacagccatgttcaggaggaaagctttcttgcattggtacacaggcgaagggatggacgagatggagtttactgaagctgagagcaacatgaacgatctcgtctccgagtatcagcaataccaagacgcaaccgcagatgaagaaggagagtatgaagaagaggaggaagaagaagtggagtatcaagactga

SEQ ID NO: 852 - protein, 448 aa, Brassica napus
MREILHIQGGQCGNQIGSKFWEVVCDEHGIDPTGRYTGNSDLQLERVNVYYNEASCGRYVPRAILMDLEPGTMDSVRTGPYGQIFRPDNFVFGQSGAGNNWAKGHYTEGAELIDAVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDSKNMMCAADPRHGRYLTASAMFRGKMSTKEVDEQMINVQNKNSSYFVEWIPNNVKSSVCDIAPRGLSMASTFIGNSTSIQEMFRRVSEQFTAMFRRKAFLHWYTGEGMDEMEFTEAESNMNDLVSEYQQYQDATADEEGEYEEEEEEEVEYQD

SEQ ID NO: 853 - DNA, 1353 bp, Brassica napus
  CDS (1)..(1353)
atgcgtgagatccttcacatccagggaggccagtgcggtaaccagatcggtgccaagttctgggaagtcgtctgcgcggagcacggcatagatccaaccggtagatacacgggagactcagatctgcagctcgagcgcatcaacgtctactacaacgaagcaagctgcgggagattcgtccctcgcgccgtcctcatggatctggagcctggaaccatggacagtctcagatctggaccttacggtcagaccttccgtcccgataacttcgtcttcgggcaatctggagccggtaacaactgggccaaggggcattacactgaaggagctgagctaatcgattcagtgctcgatgttgttcgtaaggaggctgagaactgtgactgtcttcaagggtttcaggtttgccattccttgggaggaggaactggatctggtatgggaacgcttctgatctctaagatccgtgaagagtacccagatcggatgatgcttaccttctcagtgtttccttcccctaaggtctctgataccgttgttgagccttacaacgctacgctctcggttcatcagcttgttgagaacgctgatgagtgtatggttcttgacaacgaggccttgtatgatatctgcttcaggactctcaaactcactacccctagctttggtgatttgaaccatttgatctctgccactatgtctggtgtgacttgctgtctgaggttccctggtcagctcaactccgacctccgcaagcttgctgtgaatcttatcccattcccacgtcttcacttcttcatggtgggttttgctcctctcacctcaagaggatctcagcagtaccgttccctcactgtccctgaactcacccagcagatgtgggactccaagaacatgatgtgtgctgcagacccaagacacggtcgctacctcacagcctccgccatgttccgtggcaagatgagcacaaaggaagtggacgagcagatgctgaacgtgcagaacaagaactcatcctactttgtggagtggatcccaaacaacgtgaagtcaacagtctgtgacatcccgccaactggtctgaagatggcgtcaactttcattggaaactcgacttcgatccaggagatgtttaggcgtgtgagtgagcagttcacggctatgttcaggaggaaggctttcttgcattggtacacaggggaaggaatggacgagatggagttcacagaagcggagagcaacatgaacgatctggtttcggagtaccaacaataccaggatgcaacagcagatgaggaaggtgagtacgaggatgaggaagaaggagaataccaacaggaggaagagtactga

SEQ ID NO: 854 - protein, 450 aa, Brassica napus
MREILHIQGGQCGNQIGAKFWEVVCAEHGIDPTGRYTGDSDLQLERINVYYNEASCGRFVPRAVLMDLEPGTMDSLRSGPYGQTFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRSLTVPELTQQMWDSKNMMCAADPRHGRYLTASAMFRGKMSTKEVDEQMLNVQNKNSSYFVEWIPNNVKSTVCDIPPTGLKMASTFIGNSTSIQEMFRRVSEQFTAMFRRKAFLHWYTGEGMDEMEFTEAESNMNDLVSEYQQYQDATADEEGEYEDEEEGEYQQEEEY

SEQ ID NO: 855 - DNA, 603 bp, Oryza sativa
  CDS (1)..(603)
atggctgaccaaggattggaagggagccagccggtggatctacagaagcatccttctgggatcgtgcctacccttcaaaatattgtgtccacagtcaatttggactgtaagttggacctcaaaacaattgcacttcaagctcgtaatgcagagtacaatcccaagcgttttgctgctgtcattatgaggataagagatcccaaaacaactgcacttatttttgcttctggcaagatggtttgtactggagctaagagtgaacaacagtctaaattggcagcaaggaagtatgctcgtattatccaaaagcttggcttcccagccaaatttaaggatttcaaaattcagaacattgtcggctcttgtgatgtcaagttccccatacggctggagggtcttgcatattcccatggtgctttctcaagttatgaaccagagctgtttccagggctaatctaccgtatgaagcaacctaaaatagttttgcttatatttgtctctggaaaaattgttctaacaggagccaaggtgagagatgagacttacactgcctttgaaaacatatatcccgtgcttactgagttcaggaaaaaccaacaatga

SEQ ID NO: 856 - protein, 200 aa, Oryza sativa
MADQGLEGSQPVDLQKHPSGIVPTLQNIVSTVNLDCKLDLKTIALQARNAEYNPKRFAAVIMRIRDPKTTALIFASGKMVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKNQQ

SEQ ID NO: 857 - DNA, 450 bp, Brassica napus
  CDS (1)..(450)
atggccgatcagctgaccgacgatcagatctccgagttcaaggaagctttcagcctattcgacaaggacggagatggttgcatcacgacgaaagagcttggtacagtgatgaggtcgctaggccagaacccgacagaagcagagcttcaagacatgatcaacgaagttgacgctgacggcaacggaaccatagactttcccgagtttctcaacttgatggcgcgtaagatgaaggacacggattcggaggaagagctcaaagaagctttcagggtcttcgacaaggaccagaacggtttcatctccgccgcggagctgaggcatgtgatgaccaatttgggagagaagctgactgatgaagaggttgatgagatggtcagagaagctgatgttgatggagatggtcagatcaattacgatgagtttgtcaaagttatgatggcaaagtga

SEQ ID NO: 858 - protein, 149 aa, Brassica napus
MADQLTDDQISEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMVREADVDGDGQINYDEFVKVMMAK

SEQ ID NO: 859 - DNA, 411 bp, Brassica napus
  CDS (1)..(411)
atggctcgtaccaagcagacggcgagaaaatccaccggaggaaaggcaccaaggaagcagctcgcgaccaaggcggcgaggaaatcagctccggccaccggaggagtgaagaagccccacagattccgtcccggaacggtggcgctaagagagatcaggaagtaccagaagagcaccgagctcctgatccgcaagctcccgttccagcgtctggtccgcgagatcgcgcaggatttcaagacggatctgcgtttccagagcagcgccgtcgcggcgctccaggaggcggcggaagcttacctcgtcgggctcttcgaggacacgaatctttgcgcgattcacgcgaagagggtcacgatcatgcctaaggatatccagctcgcgaggaggatcagaggcgagagagcttaa

SEQ ID NO: 860 - protein, 136 aa, Brassica napus
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRGERA

SEQ ID NO: 861 - DNA, 1389 bp, Glycine max
  CDS (1)..(1389)
atgacgtcacgatcggggcaggggagcagcggcggagggagcagcaggacccgtgtggggaagtacgagctgggtcggacgctgggcgagggcaatttcgccaaggtgaaattcgcgaggcacgtggaaactagagagaacgtcgccatcaagattctcgacaaggagaaactactcaaacacaaaatgattgcgcagataaaacgagaaatatcaacaatgaaactgattagacacccaaatgtcatacgcatgtatgaggtaatggctagcaaaacaaagatatacattgtattggaatttgtgactggtggggagctgtttgataaaattgcacgcagtgggaggttgaaagaagatgaagcaagaaaatactttcaacagcttatatgtgctgtggattactgtcatagtagaggtgttttccatagagacttaaagcctgagaatttattgctggatgctaatggagtgcttaaagtatcagattttggattgagtgcattgcctcaacaagttcgggaagatggactacttcacacaacatgcggtacgccgaattatgttgctccagaggtgattaacaacaaaggttatgacggtgcaaaggcagatttatggtcatgtggtgttattctctttgttttaatggctggctatttgccctttgaagaaaccaatctatcagctttatataaaaagattttcaaggccgagttcacatgtcctccgtggttctcttcaagtgcaaagaagctaatcaacaaaatccttgatcccaatcctgccactcggattacatttgctgaggtcattgagaatgactggttcaagaagggatataagcctcccgtatttgaacaggctaatgttagtcttgatgatttagattctattttcagtgattctacggattcacaaaatcttgttgtagagaggcgtgaagagggacctatggcacctgtggcacctgtgactatgaatgcctttgagcttatctctaaatctcagggcctcaatcttagtagtctttttgagaagcaaatgggactagttaaaagggaaacacgatttacatccaaatgttcagcagatgaaataatttcaaaaatagagaaagctgcaggacccctgggttttgatgttaagaagaacaactgtaagttaaagattcaaggtgaaaagacaggacggaaaggtcatctatctgtagccactgagatcttagaggtggccccttcactatacatggttgagctgcgaaagtctgaaggagatactctcgaatttcacaagttctacaaaaatcttgctactgggctgaaggatattgtttggaaagccgagcctatcgatgaagaaaaagatggtgccaatccatcgaaataa

SEQ ID NO: 862 - protein, 462 aa, Glycine max
MTSRSGQGSSGGGSSRTRVGKYELGRTLGEGNFAKVKFARHVETRENVAIKILDKEKLLKHKMIAQIKREISTMKLIRHPNVIRMYEVMASKTKIYIVLEFVTGGELFDKIARSGRLKEDEARKYFQQLICAVDYCHSRGVFHRDLKPENLLLDANGVLKVSDFGLSALPQQVREDGLLHTTCGTPNYVAPEVINNKGYDGAKADLWSCGVILFVLMAGYLPFEETNLSALYKKIFKAEFTCPPWFSSSAKKLINKILDPNPATRITFAEVIENDWFKKGYKPPVFEQANVSLDDLDSIFSDSTDSQNLVVERREEGPMAPVAPVTMNAFELISKSQGLNLSSLFEKQMGLVKRETRFTSKCSADEIISKIEKAAGPLGFDVKKNNCKLKIQGEKTGRKGHLSVATEILEVAPSLYMVELRKSEGDTLEFHKFYKNLATGLKDIVWKAEPIDEEKDGANPSK

SEQ ID NO: 863 - DNA, 411 bp, Zea mays
  CDS (1)..(411)
atggcccgcacgaagcagacggcgcgcaagtcaacgggcggcaaggcgccccgcaagcagctggcgaccaaggcggcgcgcaagtctgcgccggccaccggcggcgtgaagaagccccaccgcttccgccccggcaccgtcgcgctccgggagattcgtaagtaccagaagagcacggagctgctcatccgcaagttgcccttccagcgcctcgtccgtgagatcgcgcaggacttcaagaccgatctccgcttccagtcctccgccgtctctgcgctgcaggaggccgccgaggcctacctcgtggggctctttgaggacactaacctgtgcgccatccacgccaagcgcgtcaccatcatgcccaaggacatccagctcgcgcgccgcatcaggggagagagggcctga

SEQ ID NO: 864 - protein, 136 aa, Zea mays
MARTKQTARKSTGGKAPRKQLATKAARKSAPATGGVKKPHRFRPGTVALREIRKYQKSTELLIRKLPFQRLVREIAQDFKTDLRFQSSAVSALQEAAEAYLVGLFEDTNLCAIHAKRVTIMPKDIQLARRIRGERA

SEQ ID NO: 865 - DNA, 411 bp, Brassica napus
  CDS (1)..(411)
atggctcgtaccaagcaaaccgcgagaaaatccaccggaggaaaagccccgaggaagcagctcgcaaccaaggcggcgaggaagtcggctccggccaccggaggagtgaagaagccgcacaggttccgtcccggaaccgtggcgctgagggagatcaggaagtaccagaagagcacggagcttctgatccgcaagctccccttccagcgccttgtccgcgagatcgctcaggatttcaaaaccgatctgaggttccagagcagcgccgtcgcggctctgcaggaggcggcggaggcttaccttgtgggtttgtttgaggataccaatctttgcgcgattcatgctaagagggttacgatcatgcccaaggatattcagctcgcgaggaggatccgcggtgaaagagcttga

SEQ ID NO: 866 - protein, 136 aa, Brassica napus; identical to SEQ ID NO: 860

SEQ ID NO: 867 - DNA, 1173 bp, Glycine max
  CDS (1)..(1173)
atgggtgagaagagcaacgttggcggcgacgcgattaacacgacactgcttcacgggaagtacgagctgggccggctgttaggccacggaaccttcgcgaaggtgtaccacgcgcgccacctgaagacgggaaagagcgtggcgatgaaggtggtgggcaaagagaaggtggtgaaggtaggcatgatggagcagatcaagagagagatctcagccatgaacatggtgaagcacccaaacatcgtgcagcttcacgaggtcatggcgagcaagtccaagatctacatcgccatggagctcgtccgcggcggcgagctcttcaacaagatcgccagaggccgtctccgggaggagatggccagactttacttccaacaactcatctctgctgtggacttctgccacagccgcggcgtctaccaccgtgacctcaagccagagaaccttctcctcgacgacgacggcaacctcaaggtcaccgacttcggcctcagcactttctccgagcacctccggcacgacggcctgctgcacactacgtgcggcacgccggcctatgtcgcgcccgaggtgattgggaaaagaggctacgacggcgccaaggccgatatttggtcttgtggcgtaatcctctacgtacttcttgctggttttttacccttccaggatgacaacctggtggccttgtacaagaaaatttaccgcggtgacttcaagtgtccgccgtggttctcctccgaggcgcggaggctcatcaccaagctcctcgaccccaacccgaacacgcgaatcacaatttcaaaaatcatggactcgtcgtggttcaagaaacccgtgccgaagaacttgatgggaaagaaaagagaggaattggatctggaggagaagattaaacagcatgagcaggaggtttctactacgatgaatgcttttcacatcatttcgctctcggaggggttcgatttgtcgccgttgttcgaggaaaagaagagagaagagaaagagttacggtttgcgaccacgcgccccgcgagcagcgtgatttcgagattggaagatttggcgaaggcggtgaagttcgacgtgaagaagagcgagactaaggtgaggttgcagggtcaagaaaaagggcgaaaaggtaaactcgctattgctgcggacttgtacgcgtga

SEQ ID NO: 868 - protein, 390 aa, Glycine max
MGEKSNVGGDAINTTLLHGKYELGRLLGHGTFAKVYHARHLKTGKSVAMKVVGKEKVVKVGMMEQIKREISAMNMVKHPNIVQLHEVMASKSKIYIAMELVRGGELFNKIARGRLREEMARLYFQQLISAVDFCHSRGVYHRDLKPENLLLDDDGNLKVTDFGLSTFSEHLRHDGLLHTTCGTPAYVAPEVIGKRGYDGAKADIWSCGVILYVLLAGFLPFQDDNLVALYKKIYRGDFKCPPWFSSEARRLITKLLDPNPNTRITISKIMDSSWFKKPVPKNLMGKKREELDLEEKIKQHEQEVSTTMNAFHIISLSEGFDLSPLFEEKKREEKELRFATTRPASSVISRLEDLAKAVKFDVKKSETKVRLQGQEKGRKGKLAIAADLYA

SEQ ID NO: 869 - DNA, 486 bp, Zea mays
  CDS (1)..(486)
atgattaatttcgtgctcctgatcagccgccagggcaaggtgaggctcaccaagtggtattctccttacacccagaaagagaggaccaaggtcattcgcgaactcagtggactcattcttacacgagggcccaaactctgcaattttgttgagtggagaggttacaaggtcgtataccggaggtatgctagcctgtatttctgcatgtgcattgatgccgaggacaatgagcttgaagtccttgagatcatccatcatttcgtcgagatactggaccgctattttggcagtgtgtgtgagttggatttgatattcaattttcataaggcctactacatactggatgagattctcattgctggtgaacttcaagaatctagcaagaagaatgttgcaagacttattgctgcacaggattcattggtcgaggctgctaaagaggaagccagctccataagtaacatcatagctcaggctacaaaatga

SEQ ID NO: 870 - protein, 161 aa, Zea mays
MINFVLLISRQGKVRLTKWYSPYTQKERTKVIRELSGLILTRGPKLCNFVEWRGYKVVYRRYASLYFCMCIDAEDNELEVLEIIHHFVEILDRYFGSVCELDLIFNFHKAYYILDEILIAGELQESSKKNVARLIAAQDSLVEAAKEEASSISNIIAQATK

SEQ ID NO: 871 - DNA, 603 bp, Glycine max; identical to SEQ ID NO: 855
  CDS (1)..(603)

SEQ ID NO: 872 - protein, 200 aa, Glycine max; identical to SEQ ID NO: 856

SEQ ID NO: 873 - DNA, 1326 bp, Brassica napus
  CDS (1)..(1326)
atggtcggagcaaaacctatagagaacggatctgacggtggagcaagcactggtcttctccacggacgttacgagctaggccgtcttctaggccacgggacattcgctaaagtgtaccacgcgcgtaacgtaacaacgggtaaaagcgtggcgatgaaagtcgtcggaaaagagaaggtggtgaaggtcggcatggtggaccagatcaagcgcgagatctcggtgatgaggatggtgaagcatcccaacatcgtcgagctccacgaggtgatggctagcaaaaccaagatctacttcgccatggagctcgtgcgaggcggggagctgttcgccaaagtcgccaaagggaggctgcgcgaggacgtggcgcgcgtgtactttcagcagctgatctccgccgtcgatttttgccacagccgcggggtttaccaccgagatctcaagccggagaatctcttgcttgacgaagaaggcaacctcaaggtcaccgactttggtctctctgctttcaccgagcatttgaagcaagacgggcttctccacaccacttgtggaactccggcgtacgtcgcgccggaggttatactgaagaaaggatatgacggagcgaaggcggatctttggtcttgcggcgttatcctcttcgtgctcctcgcgggttacttgccgtttcaggatgataatcttgtcaacatgtataggaagatctacagaggagacttcaagtgccctgggtggctctcctccgatgcgaggaggctcgtgacgaagcttctggatccgaatccgaatacccggatcactatcgataaggtgatggattcacactggttcaagaagtcctcaacgagatcaagaaacgagccagtggccgcaacaccagaggctgaggaggatgttgatgtgtccgtgcacaagtccaaggaagagacggagacgctaaacgcgtttcacatcatcgcgttgtctgaagggtttgatctctcgccgttgttcgaggagaagaagaaagaggagaagatggagatgaggttcgcgacttctaggccggcgagtagtgtgatatcgagccttgaggaggcggcgaaggttgggaataagtttgatgtgaggaagagcgagtgtagagtgaggatcgaagggaaacagaatggccggaaagggaagttggcggtggaggcggagatattcgcggtggctccgtcgtttgttgtcgtggaggtgaagaaagatcatggggacacgcttgagtacaataacttttgtagtacggctcttagaccagctctcaaggacatcttctggacttctactacacctgcttga

SEQ ID NO: 874 - protein, 441 aa, Brassica napus
MVGAKPIENGSDGGASTGLLHGRYELGRLLGHGTFAKVYHARNVTTGKSVAMKVVGKEKVVKVGMVDQIKREISVMRMVKHPNIVELHEVMASKTKIYFAMELVRGGELFAKVAKGRLREDVARVYFQQLISAVDFCHSRGVYHRDLKPENLLLDEEGNLKVTDFGLSAFTEHLKQDGLLHTTCGTPAYVAPEVILKKGYDGAKADLWSCGVILFVLLAGYLPFQDDNLVNMYRKIYRGDFKCPGWLSSDARRLVTKLLDPNPNTRITIDKVMDSHWFKKSSTRSRNEPVAATPEAEEDVDVSVHKSKEETETLNAFHIIALSEGFDLSPLFEEKKKEEKMEMRFATSRPASSVISSLEEAAKVGNKFDVRKSECRVRIEGKQNGRKGKLAVEAEIFAVAPSFVVVEVKKDHGDTLEYNNFCSTALRPALKDIFWTSTTPA

SEQ ID NO: 875 - DNA, 1350 bp, Oryza sativa
  CDS (1)..(1350)
atgagagagtgcatctcgatccacattggtcaggctggtatccaggtcggaaatgcttgctgggagctctactgcctcgagcacggcatcgggcccgatgggcaaatgccaagcgacaagacagttggcggtggtgatgatgctttcaatactttcttcagcgagactggtgctggaaagcacgtgccacgtgcagtgtttgtagatcttgagcccactgttattgatgaggtgagaaccggaacttaccgccagcttttccacccagagcagctcatcagcggcaaagaagatgccgccaacaactttgcccgtggccattataccattgggaaagagattgttgatctgtgcttggaccgcatcagaaagcttgctgacaattgcactggactccaagggtttttggtcttcaatgccgttggtggaggaactggttctggacttggttcccttctcttggagcgtctctccgttgattatggcaagaaatcaaagcttggtttcacagtctacccctctcctcaggtgtccacctctgttgttgagccatacaacagtgtcctctccacccattctctcttggagcacaccgatgttgctgtcctcttggacaatgaagccatttatgacatctgcagacgctctctcgacattgagcgtcccacctacaccaacctcaaccgccttgtttctcaggtgatttcatctttgactgcttccttgaggtttgatggtgccctgaatgtggatgtgactgaattccagaccaacttggtcccataccctagaatccatttcatgctttcctcctatgcaccagttatctctgctgagaaggcctaccatgaacagctctcagtggcagaaattaccaacagtgcttttgagccatcgtccatgatggccaagtgtgatcctcgtcacggaaagtacatggcgtgttgcctgatgtaccgtggtgatgttgtgcccaaagatgtaaacgctgctgttgcccccatcaagaccaagaggaccattcagtttgtggattggtgtcctactggtttcaagtgtggtattaactaccagccccctcccgttgttcctgggggcgaccttgccaaggtgcagagggcagtttgcatgatttcaaactcccccagtgtggctgaagtgtttggccgcattgatcacaagtttgatttcatgtatgccaagcgtgtttttttccactggtacgtgggtgagggtatggaagaaggtgaattttttgaagcccgtgaggaccttgcagcccttgagaaggattatgaagaagtgggtgctgattttggtgggggccaggaagaggatgaagactactag

SEQ ID NO: 876 - protein, 449 aa, Oryza sativa
MRECISIHIGQAGIQVGNACWELYCLEHGIGPDGQMPSDKTVGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVAVLLDNEAIYDICRRSLDIERPTYTNLNRLVSQVISSLTASLRFDGALNVDVTEFQTNLVPYPRIHFMLSSYAPVISAEKAYHEQLSVAEITNSAFEPSSMMAKCDPRHGKYMACCLMYRGDVVPKDVNAAVAPIKTKRTIQFVDWCPTGFKCGINYQPPPVVPGGDLAKVQRAVCMISNSPSVAEVFGRIDHKFDFMYAKRVFFHWYVGEGMEEGEFFEAREDLAALEKDYEEVGADFGGGQEEDEDY

SEQ ID NO: 877 - DNA, 1344 bp, Oryza sativa
  CDS (1)..(1344)
atgagagagatcctgcacatccaaggcgggcaatgtggcaaccagatcggtgccaaattctgggaggtggtgtgtgatgagcatggcattgaccctaccgggcggtacacaggcaactcagatctgcagttggagcgtgtcaatgtgtactacaatgaggcctcctgcggtcgctttgtgcctcgtgctgttctcatggaccttgagcctggtactatggacagtgtccgcactggaccctatggccagatcttccgccctgacaactttgtgttcgggcaatctggtgctggtaacaactgggccaagggacactacactgagggtgccgagctaattgattctgttttagatgttgtgaggaaggaggctgagaactgtgactgcctgcaaggattccaagtatgccactctcttggtggtggtactggatctggtatgggtacacttttgatatcaaagatcagggaggagtaccctgaccgcatgatgctgacattctcagttttcccctcaccaaaagtatctgatactgtggttgagccatacaatgctacactctcagtccatcagttggttgagaatgctgatgagtgtatggttcttgataatgaggctctctacgacatttgcttcaggactctcaagctgaccacacctagctttggggatttgaaccatttgatttctgccaccatgagtggagtcacatgctgcctaaggttccctggtcagttgaactctgacctccgtaagctggcagtgaaccttatcccctttccccgtctccacttcttcatggtcggattcgccccgctgacatcacgtggctcccagcagtaccgtgcccttactgttcctgagctcacacagcagatgtgggatgccaagaacatgatgtgcgctgctgatcctcgccatggccgttacctcaccgcctctgccatgttccgtggaaagatgagcaccaaggaggttgatgagcagatgatcaatgtccagaacaagaactcatcctacttcgtcgagtggatccccaacaatgtgaagtccagtgtctgtgacattccaccgagaggcctctccatggcatcgaccttcattggcaactcaacatccatccaggagatgttccggagggtgagcgagcagttcactgctatgttcaggaggaaggctttcttgcactggtacactggcgaaggcatggacgagatggagttcaccgaggcagagagcaacatgaacgaccttgtctctgagtaccagcagtaccaggatgccaccgccgatgaggagggcgagtacgaggacgaggagcagcaggaggctgacgacatgtaa

SEQ ID NO: 878 - protein, 447 aa, Oryza sativa
MREILHIQGGQCGNQIGAKFWEVVCDEHGIDPTGRYTGNSDLQLERVNVYYNEASCGRFVPRAVLMDLEPGTMDSVRTGPYGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLTTPSFGDLNHLISATMSGVTCCLRFPGQLNSDLRKLAVNLIPFPRLHFFMVGFAPLTSRGSQQYRALTVPELTQQMWDAKNMMCAADPRHGRYLTASAMFRGKMSTKEVDEQMINVQNKNSSYFVEWIPNNVKSSVCDIPPRGLSMASTFIGNSTSIQEMFRRVSEQFTAMFRRKAFLHWYTGEGMDEMEFTEAESNMNDLVSEYQQYQDATADEEGEYEDEEQQEADDM

SEQ ID NO: 879 - DNA, 783 bp, Brassica napus
  CDS (1)..(783)
atggcaatagcgcgaactggagtttacgtggatgattacctcgagtatgccagcactttccctgcggagcttcagagattgctaaatacagttcgcgaactggacgagagatctcaatcgctcataaaccagacgaggcagcaaaccaagtattgcttagggcttgcctccaagaagggcagtggcaataataatcattacaacactggtcttgatgacgacgaaaccattgacaaaatgcgtaaagagattgagtccagccaggaaaatgctttaagtttgtgtacggagaaggtcttattggcccgccaagcctatgatcttattgatagtcacttaaaacgacttgatgaagatctcaataatttttctgaagatttgaagcaagaggggaagattccaacagacgagccttctgttcttcctccactacctatagttcctaagcaggaaaagcgcaagtctttttatggcacacctcagcctaagaagattgattacagagatagagagtgggatcgtgacagggacttcgagctcatgcctcctccaggaagccatcggaaagacttcacccctattgatgagcagcctatcgatcctaacgaaccgacctactgtgtctgccatcaggtgtcctttggggacatgattgcctgtgacaatgagaattgtcaaggaggtgaatggtttcactatacatgcgttggcctcacccccgaaaccagattcaaagggaaatggtattgccctacctgcaggctcctcccacagtcccattag

SEQ ID NO: 880 - protein, 260 aa, Brassica napus
MAIARTGVYVDDYLEYASTFPAELQRLLNTVRELDERSQSLINQTRQQTKYCLGLASKKGSGNNNHYNTGLDDDETIDKMRKEIESSQENALSLCTEKVLLARQAYDLIDSHLKRLDEDLNNFSEDLKQEGKIPTDEPSVLPPLPIVPKQEKRKSFYGTPQPKKIDYRDREWDRDRDFELMPPPGSHRKDFTPIDEQPIDPNEPTYCVCHQVSFGDMIACDNENCQGGEWFHYTCVGLTPETRFKGKWYCPTCRLLPQSH

SEQ ID NO: 881 - DNA, 741 bp, Brassica napus
  CDS (1)..(741)
atggaacggaatcagaagaagatggatcacgtcatcggcggaaagtttaagttgggtaggaaactcggcagcggatcgttcggtgaactttatttagggatcaatattcagactggagaagaagtcgcagttaagctggaagctgtgaagacgaggcatcctcaactgcagtatgagtcgaagatatatatgcatctccaaggaggaactggtgttccccatctcaaatggttcggagtcgggggtgactacagttgcatggttatcgaccttcttggccccagcttggaggacttattcaattactgcactcgaaagtttactttgaaatctgttttaatgcttgcagatcagttgatatgcagagttgagtacacgcattcacggggctttcttcaccgcgatattaaaccggacaactttttgatgggtcttgggcgcaaagcaaaccaggtttatatcatcgattatggccttgctaaaaaatacaaggattttcaaacacaaaagcatataccatacagggaaaacaagaatctaacgggaactgcacggtatgcaagtgtcaacacgcaccttggcattgagcaaagtagaagagatgatctggagtcacttggttatgtgttgatgtattttctacgaggaagtcttccgtggcaagggttaaaaggtgggacaaagaagcagaagtatgacaagattagtgaaaagaagatgcttactcctgtagaggtatag

SEQ ID NO: 882 - protein, 246 aa, Brassica napus
MERNQKKMDHVIGGKFKLGRKLGSGSFGELYLGINIQTGEEVAVKLEAVKTRHPQLQYESKIYMHLQGGTGVPHLKWFGVGGDYSCMVIDLLGPSLEDLFNYCTRKFTLKSVLMLADQLICRVEYTHSRGFLHRDIKPDNFLMGLGRKANQVYIIDYGLAKKYKDFQTQKHIPYRENKNLTGTARYASVNTHLGIEQSRRDDLESLGYVLMYFLRGSLPWQGLKGGTKKQKYDKISEKKMLTPVEV

SEQ ID NO: 883 - DNA, 603 bp, Brassica napus
  CDS (1)..(603)
atggctgaacaaggaatggaagggagccagccagttgaccttagcaagcatccttcagggatcgttccaactcttcaaaacattgtatcgacagtgaacttggactgcaagcttgatcttaaagccatagctttgcaggctcgtaatgctgaatataaccccaagcgttttgctgcggtaatcatgaggataagagagccaaagaccacagctttgatctttgcttctgggaaaatggtgtgtactggagctaagagtgaacatctttcgaagctggctgcaagaaagtacgctcggattgtccaaaagcttggctttcctgcaaagttcaaggatttcaagattcagaacattgtagggtcttgtgatgtcaaattccccattaggcttgaaggtcttgcatactctcacagtgctttctcaagttacgagcctgaactattcccaggactgatatataggatgaaacaaccaaagattgtactccttatttttgtgtctggaaagattgttataactggagccaagatgagagaagagacttacaccgcctttgagaatatctacccagttcttacagaattcaggaaaatccagcaataa

SEQ ID NO: 884 - protein, 200 aa, Brassica napus
MAEQGMEGSQPVDLSKHPSGIVPTLQNIVSTVNLDCKLDLKAIALQARNAEYNPKRFAAVIMRIREPKTTALIFASGKMVCTGAKSEHLSKLAARKYARIVQKLGFPAKFKDFKIQNIVGSCDVKFPIRLEGLAYSHSAFSSYEPELFPGLIYRMKQPKIVLLIFVSGKIVITGAKMREETYTAFENIYPVLTEFRKIQQ

SEQ ID NO: 885 - DNA, 411 bp, Zea mays
  CDS (1)..(411)
atggcccgcacgaagcagacggcgaggaagtcaactggcggcaaggcgccgcggaagcagctggccaccaaggcggcgcgcaagtcggctccggccaccggcggcgtgaagaagccgcacaggttccgccccggcaccgtcgctctccgcgagatccgcaagtaccagaagagcacggagctgctcatccggaagctgcccttccagcggctggtgcgtgagatcgcgcaagacttcaagaccgaccttcggttccagtcctccgctgtcgccgcgctgcaggaggccgccgaggcgtatctggtgggtctctttgaggacaccaacctctgcgccatccacgccaagagggtcaccatcatgcccaaggacatccagctcgcgcgccgcatcaggggcgagagggcctga

SEQ ID NO: 886 - protein, 136 aa, Zea mays; identical to SEQ ID NO: 860

SEQ ID NO: 887 - DNA, 411 bp, Glycine max
  CDS (1)..(411)
atggccagaacaaagcaaactgcccgtaaatcaactggtggaaaagcacctcgcaaacaacttgctactaaagctgcacgaaaaagcgccccagctgctggtggtgtcaagaagccacatcgttatagaccaggtaccgtcgctcttagagaaattagacgttatcaaaagtccactgaattgttgattcgcaagcttccattccaacgcttggtacgtgaaatcgcacaagacttcaaaactgacttacgtttccaaagttcagctattggagctcttcaagaagctgccgaagcctacttggttgcattgttcgaagatacaaatttagcggccattcatgcaaaacgtgttacaattcaaccaaaagatatccaactcgctaggcgacttcgtggtgaacgatcttga

SEQ ID NO: 888 - protein, 136 aa, Glycine max
MARTKQTARKSTGGKAPRKQLATKAARKSAPAAGGVKKPHRYRPGTVALREIRRYQKSTELLIRKLPFQRLVREIAQDFKTDLRFQSSAIGALQEAAEAYLVALFEDTNLAAIHAKRVTIQPKDIQLARRLRGERS

SEQ ID NO: 889 - DNA, 1356 bp, Glycine max
  CDS (1)..(1356)
atgagagagtgcatttccatccacattggccaggccggaattcaggtcggaaatgcttgctgggagctctattgcctcgagcatgccattcaggctgatgggcagatgccaagtgataagaccattggtggaggtgacgatgctttcaacaccttcttcagcgagaccggtgcaggaaagcacgtgcctcgtgcagttttcgtagatcttgagcccactgtcattgatgaagtcagaactggcacataccgccaactcttccatcctgagcagctcatcagcggaaaggaagatgctgcaaacaacttcgctcgtggccactatactattgggaaagagatagttgatctgtgcttggaccgtatcagaaagcttgcggacaactgcactggtctccaaggttttctggttttcaatgctgtaggtggtggcactggttcaggtctaggatcccttctcttggaacggctttcagtggattatggcaagaaatccaagctgggtttcaccgtctatccttcaccgcaagtttcaacctctgtggttgagccttacaacagtgtcctttccacccattcccttctggaacacactgatgttgccgtgctacttgacaatgaagccatatatgatatttgcaggcgttcccttgacattgatagacccacttacacaaaccttaatcgcttagtttctcaggtgatatcatcactgactgcatctctgagatttgatggtgccttgaatgtggatgttactgagttccagactaacctggtaccatatccgaggattcacttcatgctttcatcctatgctcccgtgatttcagcagagaaggcataccatgaacagctttcagttgcggagatcacaaacagcgcgtttgagccgtcctctatgatggccaagtgcgaccctcgccacggcaagtacatggcttgctgtctgatgtacagaggcgatgtggtccctaaagatgttaatgcagccgtagccattatcaagaccaagcgcactatccaatttgttgattggtgccccacagggttcaagtgcggtatcaattatcagcctccaactgttgttccagggggagatcttgccaaggtgcagagggcagtgtgcatgatctccaactccacaagtgttgctgaggttttctcacgcattgaccacaaatttgcccttatgtatgccaagagggcgtttgtgcactggtatgttggtgagggcatggaagagggtgagttttttgaggctcgtgaagatctcgctgcccttgagaaggattatgaggaggtcggagcagaggctacggaaggtgatgaaggcgaggatggagatgagtattga

SEQ ID NO: 890 - protein, 451 aa, Glycine max
MRECISIHIGQAGIQVGNACWELYCLEHAIQADGQMPSDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVAVLLDNEAIYDICRRSLDIDRPTYTNLNRLVSQVISSLTASLRFDGALNVDVTEFQTNLVPYPRIHFMLSSYAPVISAEKAYHEQLSVAEITNSAFEPSSMMAKCDPRHGKYMACCLMYRGDVVPKDVNAAVAIIKTKRTIQFVDWCPTGFKCGINYQPPTVVPGGDLAKVQRAVCMISNSTSVAEVFSRIDHKFALMYAKRAFVHWYVGEGMEEGEFFEAREDLAALEKDYEEVGAEATEGDEGEDGDEY

SEQ ID NO: 891 - DNA, 411 bp, Zea mays
  CDS (1)..(411)
atggcccgcacgaagcagacggcgaggaagtccactggcggcaaggcgccaaggaagcagctggccaccaaggcggcgcgcaagtctgccccggcgaccggcggagtgaagaagccccaccgtttccgccccggcaccgtcgcgctccgggagatccgcaagtaccagaagagcacggagctgctgatccgcaagctgccgttccagcgcctggtgcgtgagatcgcccaggacttcaagaccgacctccgcttccagagctccgccgtcgccgcgctgcaggaggcgtccgaggcctacctcgtcgggctcttcgaggacaccaacctctgcgccattcacgccaagcgcgtcaccatcatgcccaaggacatccagctcgcccgccgtatccgtggggagagggcctag

SEQ ID NO: 892 - protein, 136 aa, Zea mays
MARTKQTARKSTGGKAPRKQLATKAARKSAPATGGVKKPHRFRPGTVALREIRKYQKSTELLIRKLPFQRLVREIAQDFKTDLRFQSSAVAALQEASEAYLVGLFEDTNLCAIHAKRVTIMPKDIQLARRIRGERA

SEQ ID NO: 893 - DNA, 450 bp, Zea mays
  CDS (1)..(450)
atggcggaccagctcaccgacgaccagatcgccgagttcaaggaggccttcagcctcttcgacaaggacggggatggttgcatcacgaccaaggagctgggcactgtcatgcgctcgctggggcaaaatcctacagaggctgagctccaggacatgatcaacgaggtcgatgctgatggcaacggcaccatcgatttcccagagtttctcaaccttatggctcgcaagatgaaggacaccgactctgaggaagagctcaaggaggccttccgtgtgtttgacaaggaccagaacggcttcatctcggccgccgagctccgccatgtcatgacaaatcttggtgagaagctaactgatgaggaggtggacgagatgatccgtgaggctgatgtcgatggtgatggccagatcaactacgaggagtttgtcaaggtcatgatggccaagtga

SEQ ID NO: 894 - protein, 149 aa, Zea mays; identical to SEQ ID NO: 838

SEQ ID NO: 895 - DNA, 1038 bp, Oryza sativa
  CDS (1)..(1038)
atgccggcggcggcggcggcgaagacgctggtgccagcccgcggcggcggcgacatggaggagccgctgctggcggagtcgtcggatcgcttctcgatgttcccgatcaggtacccgcagatctgggagttctacaagaaggcggtggcgtcgttctggacggcggaggaggtggacctctccgccgacgcgcgccactgggacgccgcgctgtcgcccgacgagcgccacttcgtctcccacgtgctcgccttcttcgcggcctccgatggcatcgtgctcgagaacctcgcctccaggttcatgtccgacgtgcaggtcgccgaggctcgcgccttctacggcttccagatcgccatcgagaacatccactcggagatgtactcgcttctgctcgagacgtacatccgcgacgacgtcgagaaggaccgcctcttccgcgccatcgacaccgtccccgccgtgcgccgcaaggccgactgggccatgcgatggatcgacggcggcgagcgcttcgccgagcggctcgtcgccttcgcctgcgtcgaggggatcttcttctcgggttcattctgcgccatcttctggctcaagaagcgcggactcatgccgggcctcaccttctccaacgagctcatctcccgcgacgagggtctccactgcgacttcgcctgcctcctctacgacctcctccgcggcaagctcgacgagtcacgcgtccaggagatcgtcgccgacgccgtggacatcgagagggagttcgtctgcgacgcgctccccgtcgcgctcgtcgggatgaacggcgagctcatgagccagtacatcgagttcgtcgccgaccggctgctcatggcgctcgggtgcaagaagatgtacaacgtcgccaacccgttcgactggatggagctcatctccctgcagggcaagaccaacttcttcgagaagcgcgtcggcgactaccagaaggcgtccgtaatgtccagcctcaacggcggcgcttcttgcaaccatgtcttcagcatcgacgaggacttctga

SEQ ID NO: 896 - protein, 345 aa, Oryza sativa
MPAAAAAKTLVPARGGGDMEEPLLAESSDRFSMFPIRYPQIWEFYKKAVASFWTAEEVDLSADARHWDAALSPDERHFVSHVLAFFAASDGIVLENLASRFMSDVQVAEARAFYGFQIAIENIHSEMYSLLLETYIRDDVEKDRLFRAIDTVPAVRRKADWAMRWIDGGERFAERLVAFACVEGIFFSGSFCAIFWLKKRGLMPGLTFSNELISRDEGLHCDFACLLYDLLRGKLDESRVQEIVADAVDIEREFVCDALPVALVGMNGELMSQYIEFVADRLLMALGCKKMYNVANPFDWMELISLQGKTNFFEKRVGDYQKASVMSSLNGGASCNHVFSIDEDF

SEQ ID NO: 897 - DNA, 2007 bp, Glycine max
  CDS (1)..(2007)
atgtctttgcttcgacggagaaaagggtcggaaccgggaaagggtccgagccatagttcggaaccgaaggttctaagcgaagaggagacagaagatgataagaataagaaaaataagaagaagaagaacaacaaatggtcgtgcttcgatagctgttgttggggggtggggtgcatttgcactttgtggtggtttcttctgtttctgtatcagatgatgccttcttcgattccccagtatgtgactgaggccttcactgggcccatgccggacccaccgggcctcaagctcaagaaggaagggctcaaggtgaagcaccctgtggtttttgtgccagggattgtcactggtgggcttgaactgtgggagggtcaccagtgtgctgaagggttgttcaggaaacgcttgtggggtggtacttttggagaagtctataaaagaccttcatgctgggtggatcacatgtcactggacaatgaaacaggattggatccaccaggcataagagttaggcctgtctctggacttgtagctgctgattactttgctgcaggatacttcgtttgggcagtcctaattgctaacttggcacgcattggttatgaagaaaaaactatgtacatggctgcatatgattggagaatagcatttcagaacactgaggtgagggatcaaacactaagtcggataaaaagcaacatagaacttatggttgctactaatggtggaaataaggcagttattattccacattcaatgggggtcttgtacttcctacattttatgaaatgggttgaagcaccagctccaatgggtggtgggggaggaccagattggtgctccaaatatataaaggcagttgtaaacattggtggaccatttttaggtgttcccaaggctatagcagggctattctcagctgaggccagggatattgctgttgccaggacgatagctccaggatttttagataacgatctgtttcgcattcaaaccttgcaacatgtaatgaagatgacccgtacttgggactcaacaatgtcaatgataccaagaggaggagatactatatggggtggtcttgattggtcaccagaagaaggctatcaccctagccagaggaagcatagcagtgactatactcagttaacagaccaagagacaaatcaaacaaatgttgtcaactatggaagaatgatatcatttggcagagatgtggccgaggcacactcctctaagattgagatggctgactttcggggtgccatcaagggtcgcagtgttgcaaataccacctgtcgtgatgtgtggactgaataccatgaaatgggatttgagggagtgagagcagttgctgaacataaagtttacacagctggctctatcgtagaactccttcaatttgttgctccaaagatgatggctcgtggtagtgctcatttctcttatgaaattgctgacaatttggatgaccctaaatataatcactacaagtattggtcaaaccctttggaaacaaaactaccaaatgctcctgatatggaaatcttctctatgtatggagttggcttaccaactgaaagatcttatatttacaagttaactccctttgccgagtgttacattccttttgaaattgacaccacgcaagatggtggaagtgatgaagatagttgtctgcaaggtggagtctacactgttgatggggatgagactgtgccagttctaagttcaggctacatgtgtgctaaaggctggcgcggaaaaacaagattcaacccgtctggtatgcgcacctacgttagagaatatgatcattctcctccagccaaccttctagagggaaggggcacacaaagtggtgctcatgttgacatcatgggaaactttgcattgattgaggatgttataagagtggctgctggagccaaaggagaagatctaggaggtgataaagtgtattctgatatcttcaagtggtctgagaaaatcaagttacccctatga

SEQ ID NO: 898 - protein, 668 aa, Glycine max
MSLLRRRKGSEPGKGPSHSSEPKVLSEEETEDDKNKKNKKKKNNKWSCFDSCCWGVGCICTLWWFLLFLYQMMPSSIPQYVTEAFTGPMPDPPGLKLKKEGLKVKHPVVFVPGIVTGGLELWEGHQCAEGLFRKRLWGGTFGEVYKRPSCWVDHMSLDNETGLDPPGIRVRPVSGLVAADYFAAGYFVWAVLIANLARIGYEEKTMYMAAYDWRIAFQNTEVRDQTLSRIKSNIELMVATNGGNKAVIIPHSMGVLYFLHFMKWVEAPAPMGGGGGPDWCSKYIKAVVNIGGPFLGVPKAIAGLFSAEARDIAVARTIAPGFLDNDLFRIQTLQHVMKMTRTWDSTMSMIPRGGDTIWGGLDWSPEEGYHPSQRKHSSDYTQLTDQETNQTNVVNYGRMISFGRDVAEAHSSKIEMADFRGAIKGRSVANTTCRDVWTEYHEMGFEGVRAVAEHKVYTAGSIVELLQFVAPKMMARGSAHFSYEIADNLDDPKYNHYKYWSNPLETKLPNAPDMEIFSMYGVGLPTERSYIYKLTPFAECYIPFEIDTTQDGGSDEDSCLQGGVYTVDGDETVPVLSSGYMCAKGWRGKTRFNPSGMRTYVREYDHSPPANLLEGRGTQSGAHVDIMGNFALIEDVIRVAAGAKGEDLGGDKVYSDIFKWSEKIKLPL

SEQ ID NO: 899 - DNA, 411 bp, Brassica napus
  CDS (1)..(411)
atggctcgtaccaagcaaaccgcaaggaaatccaccggaggcaaagccccaagaaagcagctcgcaacgaaagcagccagaaaatccgctccggccaccggcggcgtgaagaagccacacagattccgtccaggaacggtggccttgagagagatcaggaagtaccagaagagcactgagcttctgatccgtaagcttcctttccagcgtctggttcgtgagatcgctcaggatttcaagacggatctgaggttccagagcagcgccgtcgcggctctacaggaagcagccgaggcttaccttgttgggttatttgaggacaccaatctctgtgcgattcatgcgaagagagtcactatcatgcctaaggatatccagctcgctaggagaatccgtggtgaaagagcttga

SEQ ID NO: 900 - protein, 136 aa, Brassica napus; identical to SEQ ID NO: 860

SEQ ID NO: 901 - DNA, 1437 bp, Glycine max
  CDS (1)..(1437)
atgggtggcacagttgttgctgaagtacccacaaagaggggaaggggcagaagggccctgaaggagaaaaccccatcaacgaacgatgctaacatcatcatagccacaccaatttcgccatcatccgaaaaggcggcacaagttgttccctcaaagaaaaaacaagattcaaagaagcagcaatctttcgaaaaagaattgctggagatgcaggaaatgctgcagcagatgcgcctcgagaaggagaagaccgaagagctcttgaaggtcaaggacgaggctctcaagctgaaggaagaagagcttgaaaaccgtggccgggagcaagagaagcttcagaccgagctcaaaaaattgcagaagttgaaggagtttaaacctaccatgaatttgcctgtgttgaaagataatgaagaaaagaaggataagaagaagaaggggtgctctgagaagaaacggccttctccaccttacattttgtggatgaaagaccaatggaatgagatcaagaaagcgaacccagaggctgaatttaaggaaatttcaaccatgctaggtgctaaatggaagactgttagtgcagaagagaagaagccttatgaggggatataccatgcggagaaagaagcttatttgcaggtgattgcaaaggaaaaacgtgaaactgaggcaatgaggttgttggaagacgagcagaagcagaggactgcgatggaattgcttgaacagtacatgcaattcaaacaagaggcagaaaaagatggcaagaagaacaagaaagagaaggatccattgaaaccaaagcaccccatgtcagcttatttcttgttcactaatgataggcgagcagctcttgctgccgagaacaagaatttcttggaggttccaaaaatcacatccgaagagtggaaaaacatgacagaagaacaaaaaagaccctatgaagagatggcaaagaaaaataaggagcaatatgccctagaaatggaggcttataaacagaagaaagatgaggaggctgcccatttcatgaaggaagaggaggagcagatgaaacttcaaaaacaagaagcattgcaactgcttaagaagaaggagaaaactgaaaatataatcaagaaaacaaaacagaaccgccagaagaagaaacagaacaaggatgacaagaattctgatccaaacaggcctaagaagcctgcatcctcattcatcttattcagcaaagaagcaaggaaaactttacaggaggagcgaccaggaatcagcacctcaacccttaatgcacttgtttcattgaagtggaaggaactgagcgaggaagatagacaattctggaatggccaagcatcaaaagcaatggatgcatacaagaaggaattggaggaatacaacaaatcccttgctgcaactgcatgccaggagcagaaaaccgaataa

SEQ ID NO: 902 - protein, 478 aa, Glycine max
MGGTVVAEVPTKRGRGRRALKEKTPSTNDANIIIATPISPSSEKAAQVVPSKKKQDSKKQQSFEKELLEMQEMLQQMRLEKEKTEELLKVKDEALKLKEEELENRGREQEKLQTELKKLQKLKEFKPTMNLPVLKDNEEKKDKKKKGCSEKKRPSPPYILWMKDQWNEIKKANPEAEFKEISTMLGAKWKTVSAEEKKPYEGIYHAEKEAYLQVIAKEKRETEAMRLLEDEQKQRTAMELLEQYMQFKQEAEKDGKKNKKEKDPLKPKHPMSAYFLFTNDRRAALAAENKNFLEVPKITSEEWKNMTEEQKRPYEEMAKKNKEQYALEMEAYKQKKDEEAAHFMKEEEEQMKLQKQEALQLLKKKEKTENIIKKTKQNRQKKKQNKDDKNSDPNRPKKPASSFILFSKEARKTLQEERPGISTSTLNALVSLKWKELSEEDRQFWNGQASKAMDAYKKELEEYNKSLAATACQEQKTE

SEQ ID NO: 903 - DNA, 768 bp, Brassica napus
  CDS (1)..(768)
atgaccgtgggagtattagctttacaaggctctttcaacgagcacatcgcggctctgcggcggctaggcgtccaaggaatcgagattaggaaggcggagcagcttctcaccgtttcatctctcataatccctggcggcgagagcaccaccatggccaaactggccgagtaccacaacctgttcccggctctacgtgagtttgtcaagacggggaaacctgtttgggggacatgcgctggtcttatcttcttggcagacagagcagttggtcagaaagagggaggtcaagaactagttggtggccttgactgcaccgtacacaggaacttctttggcagccagattcaaagttttgaagctgatatctctgtacctattctaacatctaaagaaggtgggccggagacataccgaggagtcttcatacgcgctccagctgttctcgatgttggccctgatgtcgaggttttagcgcattatcccgtcccatcaaacaaggtcttgtattcaagctctactgtccaaatccaagaggaagatgctcttctagagacgaacgtcattgttgcggtgaagcaaagaaacttgttagcgactgcgtttcatcccgagttacccgcagacccgcgatggcacagttttttcatgaaaatggcgaaagagatggaacaaggggcttcttcaagcagtggtggaacttttgtttttgttggggaaaccagcgttggtcccgggcaaactaagcctgattttcctatatatcggtaa

SEQ ID NO: 904 - protein, 255 aa, Brassica napus
MTVGVLALQGSFNEHIAALRRLGVQGIEIRKAEQLLTVSSLIIPGGESTTMAKLAEYHNLFPALREFVKTGKPVWGTCAGLIFLADRAVGQKEGGQELVGGLDCTVHRNFFGSQIQSFEADISVPILTSKEGGPETYRGVFIRAPAVLDVGPDVEVLAHYPVPSNKVLYSSSTVQIQEEDALLETNVIVAVKQRNLLATAFHPELPADPRWHSFFMKMAKEMEQGASSSSGGTFVFVGETSVGPGQTKPDFPIYR

SEQ ID NO: 905 - DNA, 1080 bp, Glycine max
  CDS (1)..(1080)
atggcagcacaagctgaaattgagcatcctaggaaagcattcggatgggcagctagggattcttccggtcttctctcccctttcaatttctgcagaagggaacccggtgagaaagatgtggcattcagagtgttgtactgtgggatatgccactcggacctccacagcataaagaacgaatggggtacttccatctatccaatggttcctgggcatgaggtagctggtgtagtaacagaggtgggaagcaaagtagagaagttcaaagttggggacaaggttggtgtgggatgcctggttgattcctgccgcacctgccaaaactgttgcgacaatcttgagaattattgtcctcaatctacgttcacatatggtgccaaatatagagatggaaccatcacatatggaggctactctgactcaatggttgctgatgagcattttgtggttcgcattccagatagattaccacttgatgctgctgcacctcttctttgtgctggcatcactgtgtatagccctctcagatattatggacttgacaagcctggtctgcatgtgggtgtggttggtcttggtggactaggccatatggctgtcaagtttgccaaagcttttggtgctaaggtcacagtaataagtacttcaccaaacaaaaaggaagaagcaatacaaaatcttggagctgattcttttctaataagccgggaccaagatcagatgcaggctgcaatgggtactttggatggtattattgacacagtttctgccgttcatcctctcttacctctcattggtttgctcaagtctcatggaaagcttgtaatggttggtgcaccggagaagcctctggaactgcctgtttttcctttacttgcggggagaaagatagttgctggcactctgattggagggctaatggagacgcaagaaatgattgattttgcagcgaaacacaatgtgaaacctgacattgaagtcattcctatggactatgtcaacacagcaatggagcgcctccttaaagcagatgttaaatatcgatttgttattgatattggaaacacactgaaattctga

SEQ ID NO: 906 - protein, 359 aa, Glycine max
MAAQAEIEHPRKAFGWAARDSSGLLSPFNFCRREPGEKDVAFRVLYCGICHSDLHSIKNEWGTSIYPMVPGHEVAGVVTEVGSKVEKFKVGDKVGVGCLVDSCRTCQNCCDNLENYCPQSTFTYGAKYRDGTITYGGYSDSMVADEHFVVRIPDRLPLDAAAPLLCAGITVYSPLRYYGLDKPGLHVGVVGLGGLGHMAVKFAKAFGAKVTVISTSPNKKEEAIQNLGADSFLISRDQDQMQAAMGTLDGIIDTVSAVHPLLPLIGLLKSHGKLVMVGAPEKPLELPVFPLLAGRKIVAGTLIGGLMETQEMIDFAAKHNVKPDIEVIPMDYVNTAMERLLKADVKYRFVIDIGNTLKF

SEQ ID NO: 907 - DNA, 450 bp, Zea mays
  CDS (1)..(450)
atggcggaccagctcaccgacgaccagatcgccgagttcaaggaggccttcagcctcttcgacaaggacggcgacggttgcatcacaaccaaggagctcggaactgtcatgcgatcactgggtcagaacccaaccgaggctgagctccaggacatgatcaacgaggtcgatgcggacggcaacggcaccatcgacttcccggagttcctcaacctcatggcccgcaagatgaaggacaccgactccgaggaggagctcaaggaggcgttcagggtgttcgacaaggaccagaacggcttcatctctgcggcggagctccgccacgtgatgaccaacctcggcgagaagctgaccgacgaggaggtcgatgagatgatccgcgaggccgacgtcgatggtgatggccagatcaactacgaggagttcgtcaaggtcatgatggccaagtga

SEQ ID NO: 908 - protein, 149 aa, Zea mays; identical to SEQ ID NO: 838

SEQ ID NO: 909 - DNA, 1368 bp, Brassica napus
  CDS (1)..(1368)
atggctacgctatcaaagctagagatggccacgaccttcctcgctttcacctctcctcgttccgccaccgccctgaactaccgcttctcttctgccgccgtcccgattttctcttggcgcatagctacgcccgtttccgtcagggcgaaaccgtcgttgctctatcccccggtggttaattccaaacgacttcgaaaattctcctccgtttcggcctcagcttccgcgtcggcgccaccgcaaacagacgattccgatgttacaactaagattccgccggacaaccgaattccagctactataatcacggggtttctgggctccggcaagacgacattactgaaccatatactgactagagatcatgggaagcgcatagccgtgatcgagaatgagtttggtgaagttgacattgacgggtcacttgttgcttccaaatctgtgggagcggaggatatagtgatgctcaacaatggctgcctgtgttgcactgttaggggtgatcttgtgaggatgatttctgagttggttaacaagaagaaagggaagttcgatcatatcgtgatagagacaacagggctggcaaacccggctccgattatccaaaccttttatgcggaggaggagattttcaatgatgtcaaactggacggtgttgttactcttgttgatgctaagcatgctcgtttgcatcttgatgaggtcaaacccaaaggtgttgtcaacgaggctgttgaacagatagcctatgctgaccgtatcatagttaataagactgatcttgtcggtgagtcagagttaggttcagtggtgcaacgcataaagacaataaacagcatggctcagatgacgaggacaaattacggaaacgttgacttggactatgttcttggaattggaggttttgatctagagagaatcgaaagctctgtgaccaccgaagatgataagaaaggtcatgatgagtgtcacgacgaacatcaccatgatcacgaccatcatcatcatgatcaccatcaccacaatgaacatgagcataatcattctcatgatcatgatcatacccatgatcccggtgtttcttcagtcagtatagtttgcgaagggagcttagaccttgacaaggcaaacatgtggctagggacgttactgatggaacgaagtgaggatatttacaggatgaaaggtctgctgtcggtccacaccatggaggagagattcgtgtttcaaggagtccatgacatctttcaaggatccccagaccggttatggggaaaagacgaggctagagtcaacaagatggtcttcattggcaagaatttgaaccgggaggagctagagaagggttttaaagcttgcttgatttga

SEQ ID NO: 910 - protein, 455 aa, Brassica napus
MATLSKLEMATTFLAFTSPRSATALNYRFSSAAVPIFSWRIATPVSVRAKPSLLYPPVVNSKRLRKFSSVSASASASAPPQTDDSDVTTKIPPDNRIPATIITGFLGSGKTTLLNHILTRDHGKRIAVIENEFGEVDIDGSLVASKSVGAEDIVMLNNGCLCCTVRGDLVRMISELVNKKKGKFDHIVIETTGLANPAPIIQTFYAEEEIFNDVKLDGVVTLVDAKHARLHLDEVKPKGVVNEAVEQIAYADRIIVNKTDLVGESELGSVVQRIKTINSMAQMTRTNYGNVDLDYVLGIGGFDLERIESSVTTEDDKKGHDECHDEHHHDHDHHHHDHHHHNEHEHNHSHDHDHTHDPGVSSVSIVCEGSLDLDKANMWLGTLLMERSEDIYRMKGLLSVHTMEERFVFQGVHDIFQGSPDRLWGKDEARVNKMVFIGKNLNREELEKGFKACLI

SEQ ID NO: 911 - DNA, 1554 bp, Brassica napus
  CDS (1)..(1554)
atggcggccatagctcgccttccactaacacattctcttccaacgatcctaaaccatacgcgcttactacctcaacgtcgtctctcctttcctacttatctcaatcgctctccctttcgctccttctcggccgtctcctcggggagtgattctaatgcttctattgtcggagatcttcttgattatcttaacgaatcatggactcagtttcacgccactgctgaggcaaagagacagcttttggctgctgggttccatctccttagcgagaacgaagactggaatctgaaacctggtggccgttacttctttactcgaaacatgtcctgtcttgttgcttttgctgtcggagataagtatgttcctggtaatggttttcatgcaatagctgctcacaccgacagtccatgtctcaaactcaaaccaaagtcagcctcttccaagtccggctatctcatggtgaatgttcagacttatggtggtggtttgtggcacacctggtttgatcgtgacttgagcgttgcggggagagcgattgtgagagctagcgatggtaactttgttcacaggcttgtcaaagtcaaaagaccattgcttcgagtccccacgttggccattcatcttgatcggacagtgaacagtgaggggttcaaaccgaatttggaaactcagcttgttccgttactggcaacgaaacaagatgaaaactcggcagaatcaaaggacaaaaacgtatctcccttctccaaagatgctcatcatccattactcatgcagattttgtcagatgacttggagtgtaagcccgaggacatagtgagtcttgagttaaatatatgtgacacccaacctagctgccttggaggagcaaacaatgagttcatattctctggaagacttgataatcttgcttcaagtttctgcgccttgagagctctcattgattcatgtgcatcatccgaaagcctttccactgaacatggtatccggatgattgttttatttgacaacgaggaggtaggttcagattcatgtcaaggtgcaggggcacccaccatgtttcaagccatgagacggattgtgagttccctaggaaatgctcaggtcacggagtgtacctttgaccgtgctatcagaaaatcttttcttgtgtctgcagatatggctcatggagtgcaccccaactttgcagacaagcatgaagagaaccaccgtcctcaactacacaagggtctggttatcaagcataacgcaaaccaacgctatgcaactagtgggatcacttcttttcttttcaaagaagttgcaaagctccatggtcttcctattcaggactttgtggtgagaaacgatatgggatgtggatcaacaataggacctatattggcttcaggagtcgggattcgaaccgttgattgtggcatagctcagctttctatgcatagtgtgagagagatttgtggaacagacgatatagacatagcgtacagacatttcaaggcgttttacagatctttctcaagcgtagataggaagctcacggtggatgattag

SEQ ID NO: 912 - protein, 517 aa, Brassica napus
MAAIARLPLTHSLPTILNHTRLLPQRRLSFPTYLNRSPFRSFSAVSSGSDSNASIVGDLLDYLNESWTQFHATAEAKRQLLAAGFHLLSENEDWNLKPGGRYFFTRNMSCLVAFAVGDKYVPGNGFHAIAAHTDSPCLKLKPKSASSKSGYLMVNVQTYGGGLWHTWFDRDLSVAGRAIVRASDGNFVHRLVKVKRPLLRVPTLAIHLDRTVNSEGFKPNLETQLVPLLATKQDENSAESKDKNVSPFSKDAHHPLLMQILSDDLECKPEDIVSLELNICDTQPSCLGGANNEFIFSGRLDNLASSFCALRALIDSCASSESLSTEHGIRMIVLFDNEEVGSDSCQGAGAPTMFQAMRRIVSSLGNAQVTECTFDRAIRKSFLVSADMAHGVHPNFADKHEENHRPQLHKGLVIKHNANQRYATSGITSFLFKEVAKLHGLPIQDFVVRNDMGCGSTIGPILASGVGIRTVDCGIAQLSMHSVREICGTDDIDIAYRHFKAFYRSFSSVDRKLTVDD

SEQ ID NO: 913 - DNA, 1419 bp, Glycine max
  CDS (1)..(1419)
atggaacctcgggttgcgaacaagttccgtcttggccgcaagattggtagcggatccttcggcgagatctatctcggtacgaatactcagacaaatgaagaggttgcagttaagctcgaaaatgtcaaaactaagcatcctcaattgttgtacgaatcaaagttgtataaaatactgcaaggaggaactgggatcccaaatgtgagatggtttggagttgaaggagattacaatgtccttgtgatggatttactgggacctagtcttgaggatttattcaatttctgtacccgtaaattgtccctcaaaactgttctcatgcttgctgatcagatgataaatcgagttgaatttattcattccaaatcatttttacatagggacatcaagccagacaacttcctaatgggtttggggaggcgtgcaaatcaagtttatgccattgactttggtcttgctaagaagcacagagacacctctacccatcaacatattccttacagagagaataagaatttgactggaactgctagatatgctagtatgaatactcatcttggaattgagcaaagccgtagggacgacttagaatcacttggatttgttcttatgtattttttgagaggaagtctcccatggcagggattgaaagcaggtactaagaagcagaagtatgagagaatcagtgagaagaaagtttctacttctattgagtctctgtgccgtagctacccctcagagttcgcttcatactttcattactgtcggtcactgcaatttgatgataaaccagattatgcttatctgaaaaggcttttccgtgaccttttcattcgtgaaggattccagtttgattatgtctttgattggaccattttgaaatatcagcaatctcaaattgccacacctcctgctcgtgctattggtcctgctgctggaccaagttctgggctgccaccagctgttgtaaatgctgatagacagacaggtggggaaaacagtaggcatactggttggtcttcatctgatcctgctcgaagaagaaactctggacctattgcaaatgatggaatgttgtcaagacaaaaagccccatttccaagtgattcaactcgatctaaagatgttatgttgtctagttctaatttccgttcaagtggatctacaaggcgaggtgttgtatcaagcagtcgtgatgcaactgttggcaatgagactgagccttctcatcctctcaccgtggatgctagtcaaggagcacttcgtaaaatctccggtgctcaaagaagttcacctattatgccatttgagcacaaccgaacatcctctggaagaaatacatcaaacatgaagaattacgagtcaactatccggggtattgagaccctaaatttcaatgacgagaggttacagtattag

SEQ ID NO: 914 - protein, 472 aa, Glycine max
MEPRVANKFRLGRKIGSGSFGEIYLGTNTQTNEEVAVKLENVKTKHPQLLYESKLYKILQGGTGIPNVRWFGVEGDYNVLVMDLLGPSLEDLFNFCTRKLSLKTVLMLADQMINRVEFIHSKSFLHRDIKPDNFLMGLGRRANQVYAIDFGLAKKHRDTSTHQHIPYRENKNLTGTARYASMNTHLGIEQSRRDDLESLGFVLMYFLRGSLPWQGLKAGTKKQKYERISEKKVSTSIESLCRSYPSEFASYFHYCRSLQFDDKPDYAYLKRLFRDLFIREGFQFDYVFDWTILKYQQSQIATPPARAIGPAAGPSSGLPPAVVNADRQTGGENSRHTGWSSSDPARRRNSGPIANDGMLSRQKAPFPSDSTRSKDVMLSSSNFRSSGSTRRGVVSSSRDATVGNETEPSHPLTVDASQGALRKISGAQRSSPIMPFEHNRTSSGRNTSNMKNYESTIRGIETLNFNDERLQY

SEQ ID NO: 915 - DNA, 486 bp, Glycine max
  CDS (1)..(486)
atgatcaactttgtgcttctcattagtcgccaagggaaggtgagactgacaaaatggtactcaccttattctcagaaagaaaggagtaaggtaatccgtgagctcagtggaatgattctttcccgtgctcccaagcaatgtaattttgtagaatggcgaggacataaagttgtttataaaaggtatgctagtctctatttctgcatgtgcattgatcaagatgacaatgaattagaagtccttgaaataattcatcattttgtggagattcttgaccggtattttggcagtgtctgtgaactggacttaatattcaactttcacaaggcctactatatactagatgaaattctaattgccggtgagcttcaagagtccagcaagaaaacagttgctcgattgatagcagcacaggattcgttggtggagaatgcgaaggaagaagtcagttcattaagtaatataattgcacaagccactaagtga

SEQ ID NO: 916 - protein, 161 aa, Glycine max
MINFVLLISRQGKVRLTKWYSPYSQKERSKVIRELSGMILSRAPKQCNFVEWRGHKVVYKRYASLYFCMCIDQDDNELEVLEIIHHFVEILDRYFGSVCELDLIFNFHKAYYILDEILIAGELQESSKKTVARLIAAQDSLVENAKEEVSSLSNIIAQATK

SEQ ID NO: 917 - DNA, 1173 bp, Brassica napus
  CDS (1)..(1173)
atgagagagatcctccacgtccaaggcgggcaatgcgggaaccaaatcggttccaagttctgggaagtcatctgcgacgagcacggcgttgatcccaccggtcgttacaacggcgactccgccgatctccagctcgagcgtatcaatgtgtattacaacgaggcttctggcgggaggtacgttcctcgcgcggttcttatggatctcgagcctggtaccatggacagcattagatccggaccgtatggtcagatattccgtcccgacaacttcgtgtttggtcagtccggggctggtaataactgggcgaaaggtcattacacggaaggtgctgagcttattgatgctgttcttgatgttgttcgtaaggaagctgagaactgtgactgccttcaagggtttcaagtgtgccactctcttggaggaggcacaggttctggaatgggaactctattgatatcaaagatccgtgaggaatatccagacaggatgatgctcacattctctgttttcccatctccaaaggtctcagacactgtcgttgagccttacaacgccactctctctgtccatcagctcgttgagaacgctgatgaatgcatggtcctcgacaacgaagccctctacgacatctgtttccgtactctcaaactcagcactcctagttttggagacttgaaccatttgatctcagccactatgagtggtgtgacttgctctctaaggttccctggacaactcaactccgacctaagaaaactcgcagtcaaccttatcccattccctcgtctccacttcttcatggtcggtttcgctcctctcacctcccgcggctcccagcagtacatctccctcacagtccccgagctcacccaacaaatgtgggacgccaagaacatgatgtgcgcagctgatcctcgccacggacgttacctaacagcctcagccatgttcagaggaaagatgagcacgaaggaagtcgacgagcagatcttgaacgtccagaacaagaactcatcctacttcgttgagtggatcccaaacaacgtcaagtccagcgtctgcgacatcccgccgaccggtatcaaaatggcgtctacctttgtcggaaactcgacttcgatccaggagatgtttaggagagtgagcgaacagttcacggctatgttttag

SEQ ID NO: 918 - protein, 390 aa, Brassica napus
MREILHVQGGQCGNQIGSKFWEVICDEHGVDPTGRYNGDSADLQLERINVYYNEASGGRYVPRAVLMDLEPGTMDSIRSGPYGQIFRPDNFVFGQSGAGNNWAKGHYTEGAELIDAVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLSTPSFGDLNHLISATMSGVTCSLRFPGQLNSDLRKLAVNLIPFPRLHFFMVGFAPLTSRGSQQYISLTVPELTQQMWDAKNMMCAADPRHGRYLTASAMFRGKMSTKEVDEQILNVQNKNSSYFVEWIPNNVKSSVCDIPPTGIKMASTFVGNSTSIQEMFRRVSEQFTAMF

SEQ ID NO: 919 - DNA, 891 bp, Glycine max
  CDS (1)..(891)
atgttccttcttagaaggcaaacccagaatcaccatgagaatgattcctcatatcaagatacaaaggtggctgaactcaagacagctcttgggcccctctctggtcgtcaattaaagtattgcacagatgcatgtctaaggagatatttagaagcaaggaactggaatgttgataaaaccaagaaaatgctggaggaaacacttgagtggagggcaacttataggccagaggaaatccgttgggctgaaatagcacatgagggtgagacaggcaaagtctccagagctaactttcatgatcgacatgggagggctgtgcttattatgaggccagggatgcagaatacaacatcggctgaagataatatcaggcatttagtctatctgttggaaaatgctatcctgaatctttctgaaggtcaagaacaaatgtcatggttgatagacttcacaggattatcacttagtacaaatatatctgttaaaacatctcgtgatattattcacattttacaaaaccactatccagaaaggcttgctatcgcttttctgtacaatcccccaagaatatttcaggctttctggaaggccatcagattcttcctggatcccaacacagtccagaaggtgaagtttgtttatcctaacaataaggacagtgtggagctgatgaaatcactcttcgacatggaaaaccttccaagtgaatttggggggaaaacaagtttaaagtatgaccatgaagagttctcgcgattgatgactgaggatgatgtgaaaactgccaagttctggggacttgatgaggagcccttcaaccctcctaagaaggggcattctggagcagaggtggcaccagaaccagtgcctgttcaggcagtagttagttag

SEQ ID NO: 920 - protein, 296 aa, Glycine max
MFLLRRQTQNHHENDSSYQDTKVAELKTALGPLSGRQLKYCTDACLRRYLEARNWNVDKTKKMLEETLEWRATYRPEEIRWAEIAHEGETGKVSRANFHDRHGRAVLIMRPGMQNTTSAEDNIRHLVYLLENAILNLSEGQEQMSWLIDFTGLSLSTNISVKTSRDIIHILQNHYPERLAIAFLYNPPRIFQAFWKAIRFFLDPNTVQKVKFVYPNNKDSVELMKSLFDMENLPSEFGGKTSLKYDHEEFSRLMTEDDVKTAKFWGLDEEPFNPPKKGHSGAEVAPEPVPVQAVVS

SEQ ID NO: 921 - DNA, 813 bp, Glycine max
  CDS (1)..(813)
atgagtgagaatcatgtgaagtgccgccgcgtacacacacatacacattcactctctctctctcttaacttgtctgttaaattcaacaaaaacacaccctttgtgagaacttgttgttgttgttgttgttcaatggctgcaacagcttcaaggttcatcaagtgtgtgacagtcggggatggagctgtaggcaaaacttgcatgctcatttgctatacaagcaacaaattccccacggactatattccaacggtgtttgataatttcagtgcaaatgtggttgttgaaaacacaactgtcaatttaggcctctgggacactgctgggcaagaggattacaacaggctgaggccattgagctacaggggggcagatgtctttgtcttggctttctctttagttagccatgcaagctacgaaaatgtgttgaagaagtgggttcctgaactgcagcattttgctcctggtgtcccagtggtgctagttggcaccaaattggatcttcgagaagacaagcactatttggctgatcatcctggtctggcgcctgtgacttctgagcaaggtgaggaattgcgtaaactggtcggagctacgtattatatagagtgcagctcaaagactcagcagaatgtgaagtcagtttttgatgctgctatcaaggtggtcatcgagcctccacaaaaacatgagaagaagaaaaaaccacgtcgagggtgtctactgtcagtacacttttttcatatcataacaactcctgcacgtgaaactttcttacttgtgaaaagggatagatcattaagtgttcattga

SEQ ID NO: 922 - protein, 270 aa, Glycine max
MSENHVKCRRVHTHTHSLSLSLNLSVKFNKNTPFVRTCCCCCCSMAATASRFIKCVTVGDGAVGKTCMLICYTSNKFPTDYIPTVFDNFSANVVVENTTVNLGLWDTAGQEDYNRLRPLSYRGADVFVLAFSLVSHASYENVLKKWVPELQHFAPGVPVVLVGTKLDLREDKHYLADHPGLAPVTSEQGEELRKLVGATYYIECSSKTQQNVKSVFDAAIKVVIEPPQKHEKKKKPRRGCLLSVHFFHIITTPARETFLLVKRDRSLSVH

SEQ ID NO: 923 - DNA, 591 bp, Zea mays
  CDS (1)..(591)
atgatccaggcggtgatggtgatcagcacccaggccaagccccgccttctcaagttctacagtttccagccacccgagaagcatcaggacctcgtccgctgtgtcttccaattactctctgcaaggcccgagagcgcgagcaattttgtcaaggtggactccatctttggcccgggaacaaaaatggtctacaagcatttggccacactatactttgtttttgtctttgatagctctgagaacgagcttgccatgctcgacctcgtacaagtgtttgttgaaacattggacagatgcttcaagaatgtatgcgagcttgacatcgtatttaacttcaacaaggtaccatatgtccatatgatcctactttttttatccttttatactagaatagtgtgcctatcgaggatgcatggtttctatcctgctgaaaattccatttatgattcttcagttgcatgttttaggcagcagaaaaggtgggacacagaagctgcatcaccatttttgacagcagttgggttatctgtatcaaattacgcctttttatgcacatgtcatatgcagtgctgtgcaaatctgaaagtttga

SEQ ID NO: 924 - protein, 196 aa, Zea mays
MIQAVMVISTQAKPRLLKFYSFQPPEKHQDLVRCVFQLLSARPESASNFVKVDSIFGPGTKMVYKHLATLYFVFVFDSSENELAMLDLVQVFVETLDRCFKNVCELDIVFNFNKVPYVHMILLFLSFYTRIVCLSRMHGFYPAENSIYDSSVACFRQQKRWDTEAASPFLTAVGLSVSNYAFLCTCHMQCCANLKV

SEQ ID NO: 925 - DNA, 651 bp, Brassica napus
  CDS (1)..(651)
atggcttcaagtgcttcaaagttcatcaaatgtgtaactgttggtgatggtgccgttggtaaaacctgtatgctcatctgctataccagcaacaagttccctactgactatgtaccaacggtttttgacaactttagtgcaaacgttgtagttgaaggaactactgtgaacttagggctatgggatactgctggacaagaagactataacagattaaggcctttaagctacagaggagcagatgtcttcgtcttgtctttctcattggttagccgagctagctacgagaatgtttttaaaaagtggatccctgaactccaacactttgctccaggagttccattagttcttgtcggtaccaaattagatctccgtgaggataagcattatctggctgaccatcctggactatcccctgtaactactgcacagggagaggagttgcgtaagctcattggtgcaacatattacattgaatgtagctcaaaaactcaacagaatgtcaaagcagtttttgattcggcaatcaaggaagtgatcaaaccggtgcttaaacagaagggcaagaccaagaaaaagaagaagcaacagtcgaatcaccacgggtgtttatcaaacgttttgtgtgggaggatagtgacccggcattga

SEQ ID NO: 926 - protein, 216 aa, Brassica napus
MASSASKFIKCVTVGDGAVGKTCMLICYTSNKFPTDYVPTVFDNFSANVVVEGTTVNLGLWDTAGQEDYNRLRPLSYRGADVFVLSFSLVSRASYENVFKKWIPELQHFAPGVPLVLVGTKLDLREDKHYLADHPGLSPVTTAQGEELRKLIGATYYIECSSKTQQNVKAVFDSAIKEVIKPVLKQKGKTKKKKKQQSNHHGCLSNVLCGRIVTRH

SEQ ID NO: 927 - DNA, 411 bp, Oryza sativa
  CDS (1)..(411)
atggcccgtaccaagcagaccgctcgtaagtccacaggaggaaaggctcccaggaagcagcttgcaaccaaggctgctcgtaagtctgctcccaccactggaggagttaagaagccccaccgttaccgccctggaactgttgccctccgtgagattcgcaagtaccagaagagtactgagcttttgatcaggaagctgcccttccagaggcttgttagggaaattgcacaggacttcaagaccgatctgcgtttccagagccatgctgtccttgccctccaggaggctgcggaggcataccttgttggtctcttcgaggacaccaacctgtgcgctattcatgccaagcgtgtgaccatcatgcctaaggacattcagctggctaggaggattcgtggtgagagggcttaa

SEQ ID NO: 928 - protein, 136 aa, Oryza sativa; identical to SEQ ID NO: 826

SEQ ID NO: 929 - DNA, 411 bp, Brassica napus
  CDS (1)..(411)
atggctcgcaccaagcagacggcaaggaaatcaaccggaggcaaggccccaaggaagcagctagcaacaaaagcagcgaggaaatcagctccagccaccggaggagtgaagaagccgcacagattcaggccaggaacagtggctctaagagagatcaggaagtaccagaagagcaccgagctcctgatccgcaagctcccgttccagaggctagtgagagagatcgctcaggatttcaagacggatctccgtttccagagcagcgccgtcgccgctctccaggaagctgccgaggcttacctcgtcggactgtttgaggatactaatctgtgtgcgatccacgccaagagggtgacgatcatgcctaaggacatacagctcgccagaagaatcagaggtgaaagggcttag

SEQ ID NO: 930 - protein, 136 aa, Brassica napus; identical to SEQ ID NO: 860

SEQ ID NO: 931 - DNA, 1476 bp, Brassica napus
  CDS (1)..(1476)
atggctccagtcccatctccgcaagtgctactcccccgtcttctcggtaaagtcattactaaagacgcgaagaaagagaccagtactccagagagccctaagagtccaaaaaccccacaaggctctatcctcatggacaagtacgagttaggaaagcttcttggccacggaagcttcgctaaagtctatctcgcccggaacattaacaccggcgagaacgtcgccatcaaagtcatcgacaaagaaaagatcgtcaaaagcggtttagccggccacataaaacgtgagatatccatcctccgccgcgtccgccacccttacatcgtccacctcctcgaggtcatggctacaaagaccaagatctacatcgtcatggagtacgtacgaggcggagacctttacacaaaggtctccaaagggcggctccgcgaaggagtcgcccgtagatatttccaacagctgatctcctcggtttccttctgccacggccgcggcgtttaccaccgcgacctgaagctcgagaatcttcttttagacgacgaagggagccttaaggtatctgacttcggtctcagcgtcgtctccgagcagctcaagcaagacgggatctgccagacgttttgcgggacgcctgcttatctggcgcctgaggttttcacgaggaaaggctacgacgcggctaaagccgatgtgtggtcttgcggagtgatcttgtttgtgttgatggctggttaccttccttttgatgataagaacgttatgtttatgtacaagaagatattcaaaggacagtttaaatgtcctcattggttttcacctgagcttacgaggcttatggggaggatcttggacacgaatccggatacaagaatcacgatatcggagatcatgaagcatagatggttcaagaaagggtttaaagatgttaaattctatatcgaaaacgataagttatgtagagaggatgatgatgatgatgaatatgattcgttgtcatcagggagatcatctactgcctcagagggagatgcagagtttgtgattaaacgagttggttcaatgccgagacccgccagtctaaacgcatttgacatcatatcattctcttcgggattcgatctttctggcttgtttgaagaaggaggacaaggagcgaggtttgtatccgctgctcccgtgacaaagattatatcaaagttggaagagattgcgaatgtggcgaaatttaccgtgaggaagaaggattggagcgtgaggctagaaggtagtagagaaggtgctaaaggaccgctgactattaaggttgagatattcgagttgacaccgtctcttgtggtggttgaagtgaagaagaaaggagggtttatagaagagtatgaagagttttgcagcaaggagcttagaccacagctagagaaaatgatgcattaccaagcagatgaagttgaagtagcaatgtgtttggtcccatgttaa

SEQ ID NO: 932 - protein, 491 aa, Brassica napus
MAPVPSPQVLLPRLLGKVITKDAKKETSTPESPKSPKTPQGSILMDKYELGKLLGHGSFAKVYLARNINTGENVAIKVIDKEKIVKSGLAGHIKREISILRRVRHPYIVHLLEVMATKTKIYIVMEYVRGGDLYTKVSKGRLREGVARRYFQQLISSVSFCHGRGVYHRDLKLENLLLDDEGSLKVSDFGLSVVSEQLKQDGICQTFCGTPAYLAPEVFTRKGYDAAKADVWSCGVILFVLMAGYLPFDDKNVMFMYKKIFKGQFKCPHWFSPELTRLMGRILDTNPDTRITISEIMKHRWFKKGFKDVKFYIENDKLCREDDDDDEYDSLSSGRSSTASEGDAEFVIKRVGSMPRPASLNAFDIISFSSGFDLSGLFEEGGQGARFVSAAPVTKIISKLEEIANVAKFTVRKKDWSVRLEGSREGAKGPLTIKVEIFELTPSLVVVEVKKKGGFIEEYEEFCSKELRPQLEKMMHYQADEVEVAMCLVPC

SEQ ID NO: 933 - DNA, 1425 bp, Glycine max
  CDS (1)..(1425)
atgccgagggaaatcatcactctccaggttggccaatgtgggaatcagatcggcatggagttctggaagcagctctgcctcgaacacggcatcagcaaagaaggcatcctcgaagacttcgccactcaggggggtgaccgtaaagacgtgtttttctaccaagctgatgaccagcattatataccacgggctctcctgattgacttggagccaagagtgattaatggaattcaaaatagtgactaccgaaatctctacaatcatgagaacatctttgtctcagatcacggaggtggtgctggaaacaattgggccagtggatacgatcagggacaacatgttgaagaagaaataatggacatgattgacagagaagcagatggcagtgacagtcttgagggttttgttctatgtcattcaattgcaggaggaacaggctcaggtatgggctcatacttgttggagactctgaatgaccgctacagcaaaaaactggttcagacatacagtgtgtttcctaaccaaatggagactagtgatgtggtggtccaaccatacaattcacttttaacactcaagagattgacacttaatgcagattgtgttgtagttcttgacaatactgcactaaatagaattgctgtggaacggcttcatttatcaaatccatcatttgctcaaacaaattccttagtttctacagttatgtctgccagcacaacaactcttcgttatccagggtacatgaataatgacttggttggtcttcttgcctctttgattccaacaccaagatgccattttctaatgacaggctatacacctttgactgtggaacaccaggctaatttaattcgtaagactactgtacttgatgttatgagaagacttctgcaggcaaagaatattatggtctcttcttatgctcggacaaaagatgctagccaagcaaaatatatatcaattctgaatatcatccaaggagaggttgatccaactcaggttcatgaaagtttgcagaggattcgtgaaagaaaactagttaactttattgagtggggtcctgcaagtattcaggttgctctatcaaggaagtctccttatgttcaaactgcacatagggtcagtggccttatgctggcaagtcatactagcatccgtcaccttttcagtaaaacattgagccagtatgagaagttgagaaagaaacaagcctttatagacgcctacaggaagtttcctatgtttgctgataatgacctctcagaatttgatgaatcaagggacataattgagactttggttgatgaatacaaggcctgtgagtccccagattatatcaaatggggaatggaggatccaaacaacatgctaacaggagaaggcaatgctacaggatcattggatccaaattcagtagcgtga

SEQ ID NO: 934 - protein, 474 aa, Glycine max
MPREIITLQVGQCGNQIGMEFWKQLCLEHGISKEGILEDFATQGGDRKDVFFYQADDQHYIPRALLIDLEPRVINGIQNSDYRNLYNHENIFVSDHGGGAGNNWASGYDQGQHVEEEIMDMIDREADGSDSLEGFVLCHSIAGGTGSGMGSYLLETLNDRYSKKLVQTYSVFPNQMETSDVVVQPYNSLLTLKRLTLNADCVVVLDNTALNRIAVERLHLSNPSFAQTNSLVSTVMSASTTTLRYPGYMNNDLVGLLASLIPTPRCHFLMTGYTPLTVEHQANLIRKTTVLDVMRRLLQAKNIMVSSYARTKDASQAKYISILNIIQGEVDPTQVHESLQRIRERKLVNFIEWGPASIQVALSRKSPYVQTAHRVSGLMLASHTSIRHLFSKTLSQYEKLRKKQAFIDAYRKFPMFADNDLSEFDESRDIIETLVDEYKACESPDYIKWGMEDPNNMLTGEGNATGSLDPNSVA

SEQ ID NO: 935 - DNA, 1446 bp, Brassica napus
  CDS (1)..(1446)
atggacttgaaaatggataatgtaatcggtggcaagtttaagcttggtcggaagatcggcggtggctcttttggagagctttttcttggagtaagtgtgcaaaccggagaagaggtcgctgtaaagctggagcctgcgaaaactaagcatccacaacttcattatgagtccaagatttatatgcttctacaaggaggaactggcatccccagcctcaagtggtttggggttcagggagactacaatgcgatggtcattgatctccttggtccgagtttggaagatttgttcaactattgtaatagaaagctcactttgaaggcagttctgatgcttgcggatcaactgattagcagagttgagtatatgcattcaagaggatttctacaccgagacataaaaccagacaatttcttgatgggacttggtcgcaaagcaaaccaggtgtatgtcattgattttggccttgcaaagaagtatagggatctccaaacacatagacacatcccctacagagaaaacaagaaccttacgggcacagctcggtatgctagcgtcaacactcaccttggtgttgagcaaagtcgaagggatgatctggagtctcttggttacgtgctcatgtatttcctcagaggaagcctgccatggcagggactaaaagctggcacaaagaagcagaagtatgacagaatcagtgagaagaaagtttcaactcctatagaggtcttgtgcaagtcctatccacaagaattcgtatcatactttcaatactgcaggtccttgcgattcgaagacaaaccagactactcgtatctaaagaggctattccgggatttgtttatccgcgaaggctatcagtttgactatgtatttgactggactgcactgaaacaccctcagagtagttctagctcccggtccagctcacacggaaggcatcgtacgggtaaaccagttgcggccgcaggaccgtctgctgagaaacctgaaaggatctcagttgggagggaaatccgcgacagattctctggtgcagttgaagcattcgcgagaaggaacgctacaggagccactccccatcaaaaccaaaccaagcatcgaactcttgacgatgttcctccaccaatgaaacctgctgtgaatatggtatctgagaaaggaagaaacacttccggatacggcagtgcttcaaggagagcggtggcctcagggagtagaccaagctcatcaggtgaacaaggggacagccgcggttcaagccgtgtggcctctagtggaggtggtgttcgaccttctgttttccagagagctcaagcggcagctggtgtgagtggatatgagtcgaagacagcctctgcctttaaccgcaacagagtggctgcttctaggactgcacgtgacgatgctctcagaagctttgagcttctttctatccgcaaatga

SEQ ID NO: 936 - protein, 481 aa, Brassica napus
MDLKMDNVIGGKFKLGRKIGGGSFGELFLGVSVQTGEEVAVKLEPAKTKHPQLHYESKIYMLLQGGTGIPSLKWFGVQGDYNAMVIDLLGPSLEDLFNYCNRKLTLKAVLMLADQLISRVEYMHSRGFLHRDIKPDNFLMGLGRKANQVYVIDFGLAKKYRDLQTHRHIPYRENKNLTGTARYASVNTHLGVEQSRRDDLESLGYVLMYFLRGSLPWQGLKAGTKKQKYDRISEKKVSTPIEVLCKSYPQEFVSYFQYCRSLRFEDKPDYSYLKRLFRDLFIREGYQFDYVFDWTALKHPQSSSSSRSSSHGRHRTGKPVAAAGPSAEKPERISVGREIRDRFSGAVEAFARRNATGATPHQNQTKHRTLDDVPPPMKPAVNMVSEKGRNTSGYGSASRRAVASGSRPSSSGEQGDSRGSSRVASSGGGVRPSVFQRAQAAAGVSGYESKTASAFNRNRVAASRTARDDALRSFELLSIRK

SEQ ID NO: 937 - DNA, 459 bp, Oryza sativa
  CDS (1)..(459)
atgaaaggaggaaagtccaagaccgaatctaagagagccgatgccaaacttgctgtgaataagaagggcgccgccaccaagactaggaaacccgccggaaaggggaaggcagcgaaagatcctaacaagccaaagaggcctccaagtgctttcttcgttttcatggaggaattcaggaaggtgttcaacaaggaacatcccgacaacaaagcagtgtctgctgtgggcaaagctgctggagcaaaatggaagacgatgtctgatgctgaaaaagcaccttatgtggcaaagtctgagaaaaggaaagtggagtacgagaagaacatgagagcttataacaagaaacaggcggaaggtcctactggtggggatgaagaagaatctgagaagtctgtatctgaggtgaatgatgaggatgatgacgaggaaggcagtggcgaggaggaggatgacgattag

SEQ ID NO: 938 - protein, 152 aa, Oryza sativa
MKGGKSKTESKRADAKLAVNKKGAATKTRKPAGKGKAAKDPNKPKRPPSAFFVFMEEFRKVFNKEHPDNKAVSAVGKAAGAKWKTMSDAEKAPYVAKSEKRKVEYEKNMRAYNKKQAEGPTGGDEEESEKSVSEVNDEDDDEEGSGEEEDDD

SEQ ID NO: 939 - DNA, 411 bp, Brassica napus
  CDS (1)..(411)
atggctcgtaccaagcaaacagcaaggaagtccaccggaggaaaggctccgaggaagcagctggcaaccaaagcggcgaggaaatcggctccggcgaccggaggagtgaagaagccgcacagattccgtcccggaacggtggcgttgagggagatcaggaagtaccagaagagcaccgagcttctgatccggaagctccctttccagcgccttgtccgtgagatagctcaggatttcaagacggatctgaggttccagagcagcgccgtcgcggctcttcaggaagctgcggaggcttacctcgttggtttgttcgaagacacgaatctctgtgcgattcacgcgaagagggttacgattatgcctaaggacatccagcttgcaagaagaatcaggggtgagagggcttaa

SEQ ID NO: 940 - protein, 136 aa, Brassica napus; identical to SEQ ID NO: 860

SEQ ID NO: 941 - DNA, 447 bp, Brassica napus
  CDS (1)..(447)
atgggcaaggacggcttgagcgacgaccaggtctcctcaatgaaggaagccttcacgctcttcgacaccgacggcgacggcaaaatcgccccctccgagctcgggatcctgatgcgatccctcggcgggaacccgacccaagcccagctgaaatccataaccgcctccgagagcctcacctcccccttcgatttcagccgtttcctcgatctgatggcgaagcatttgaagacggagcccttcgatcgccagctcagggatgctttcaaggtgctcgacaaggaagggagcgggtttgttgccgtggcggatctgaggcatatattgacgagtatcggggagaagctggaggggagtgagtttgatgagtggatcaaggaggtggatgtgggatccgatgggaagattaggtatgaggattttattgcgaggatggttgctaagtag

SEQ ID NO: 942 - protein, 148 aa, Brassica napus
MGKDGLSDDQVSSMKEAFTLFDTDGDGKIAPSELGILMRSLGGNPTQAQLKSITASESLTSPFDFSRFLDLMAKHLKTEPFDRQLRDAFKVLDKEGSGFVAVADLRHILTSIGEKLEGSEFDEWIKEVDVGSDGKIRYEDFIARMVAK

SEQ ID NO: 943 - DNA, 1581 bp, Brassica napus
  CDS (1)..(1581)
atggaaggtggtagcccggagaagatagttggtgtgggagaagatccaagcacagctccagtccctgaaagggtacaagttggaagctctcctgtttataagactgagaggaaactcggtaaaggaggctttggtcaagtttttgttggtagaagggtgagtggtggcagcgataggattggccctgatgcagttgaggtggctctgaaatttgagcacaaaaatagcaaaggatgcaattttggtccaccttacgagtggcaagtgtacagtaatctcaacggttgctatggagttcctgcggtacattataagggtcgtcaaggagatttttacatccttgtcatggacatgcttggtccgagtctctgggatgtttggaactcttcagggcaatcgatgtcaccaaacatggtagcgtgcattgcagttgagtctatatctattcttgagaaacttcacatgaaagggtttgtccatggagatgtgaagcctgaaaactttttactcggtcaacccggaacagcagatgagaaaaaactctaccttatcgatcttggtctagcatcaaaatggaaagaagctcactcaggcctgcatgttgaatatgatcaaagacctgatgtgttcagggggactgtaaggtatgcaagtgttcatgcacatctaggacgtactggaagtcgaagagatgatcttgagtcattggcttatactctaatttttctattgaaaggaagattgccatggcaaggttaccagggtgataacaagagctttcttgtttgcaagaaaaagatgtcaacttctcctgaagtgatgtgctgtttctgtccaccaccgtttaagctattccttgaggcagttactaatctgaagtttgacgaggagcctaattatgcaaagcttatttcgattttcgatactttaattgagccgtgcgctctatctagaccagttagaatcgatggggctctcaaggttggacaaaagcgtggaagactggttctcaatttggaagaggatgaacaaccgaagaagaagatcagaataggcactcctgccactcaatggatttcagtttataatgctcgtcgtcccatgaaacagagatatcactacaatgttgcagagacaagactgagccagcatgtacagaagggtaatgaagatggtcttttgattagctgtgtagcatcagcagcgaatctctgggcccttattatggatgctggaactggatttacctctcaagtttatgaattgtcaaaggtcttcctgcacaaggattggattatggaacaatgggaaaagaactactatataagttccatagctggtgcagataacgggagctccttagttgttatgtcaaaaggaactacttatactcagcagtcatacaaagtgagcgactcgtttccattcaagtggataaacaagaaatggaaagaagattttcatgtgacgtccatgacaactgctggtaatcgttggggtgtggtaatgtcgaggaactctggcttctctgatcaggtggtggagcttggactttttgtacccaagcgatggaatacatag

SEQ ID NO: 944 - protein, 526 aa, Brassica napus
MEGGSPEKIVGVGEDPSTAPVPERVQVGSSPVYKTERKLGKGGFGQVFVGRRVSGGSDRIGPDAVEVALKFEHKNSKGCNFGPPYEWQVYSNLNGCYGVPAVHYKGRQGDFYILVMDMLGPSLWDVWNSSGQSMSPNMVACIAVESISILEKLHMKGFVHGDVKPENFLLGQPGTADEKKLYLIDLGLASKWKEAHSGLHVEYDQRPDVFRGTVRYASVHAHLGRTGSRRDDLESLAYTLIFLLKGRLPWQGYQGDNKSFLVCKKKMSTSPEVMCCFCPPPFKLFLEAVTNLKFDEEPNYAKLISIFDTLIEPCALSRPVRIDGALKVGQKRGRLVLNLEEDEQPKKKIRIGTPATQWISVYNARRPMKQRYHYNVAETRLSQHVQKGNEDGLLISCVASAANLWALIMDAGTGFTSQVYELSKVFLHKDWIMEQWEKNYYISSIAGADNGSSLVVMSKGTTYTQQSYKVSDSFPFKWINKKWKEDFHVTSMTTAGNRWGVVMSRNSGFSDQVVELGLFVPKRWNT

SEQ ID NO: 945 - DNA, 411 bp, Oryza sativa
  CDS (1)..(411)
atggcccgcacgaagcagacggcgaggaagtccaccggcggcaaggcgccgaggaagcagctggcgacgaaggcggcgcgcaagtcggccccggcgaccggcggcgtgaagaagccccaccgcttcaggccgggaaccgtcgcgctccgggagatccgcaagtaccagaagagcacggagctgctcatccgcaagctgccgttccagcggctggtgcgggagatcgcgcaggacttcaagaccgacctccgcttccagagctccgccgtcgccgcgctgcaggaggccgccgaggcctacctcgtcgggctcttcgaggacaccaacctctgcgccatccacgccaagcgcgtcaccatcatgcccaaggacatccagctcgcccgccgcatccgtggcgagagggcgtag

SEQ ID NO: 946 - protein, 136 aa, Oryza sativa; identical to SEQ ID NO: 860

SEQ ID NO: 947 - DNA, 342 bp, Glycine max
  CDS (1)..(342)
atgcggtcacttggccagaacccaactgaggcagagctgcaggacatgataaatgaggttgatgctgatgggaatggtaccattgatttcccagaattcctgaatctcatggctcgcaagatgaaagacactgattcagaggaggagctgaaggaggctttccgcgtgtttgacaaggatcagaatggcttcatctctgcagcggagctccgccatgtgatgaccaatctcggtgagaagctgaccgacgaggaagtcgatgagatgattcgcgaggctgacgttgatggtgatggtcagatcaactatgaggagtttgtcaaagtcatgatggccaagtga

SEQ ID NO: 948 - protein, 113 aa, Glycine max
MRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 949 - DNA, 615 bp, Brassica napus
  CDS (1)..(615)
atgggtgcgtacaagtatgtgtctgagctatggaggaagaagcagtccgatgtcatgaggttcgtgcagagggtgaggtgctgggagtacagacagcaaccttccattgtccgtctcgtcaggcctactcgtcccgacaaggctcgtcgtttgggttacaaggccaagcagggctttgtggtgtaccgtgtccgtgtgagacgtggtggacgcaagaggccagtgccaaagggtattgtctacggtaagcccactaaccagggagtaacccaactcaagttccagaggagcaagcgttctgttgctgaggagcgtgctggaaggaaattgggcggcctcagagtcgtcaactcctactggctcaacgaggattcgacctacaagtactacgagattatcttggtcgacccggcacacaatgctgtgcgtaatgacccgagaatcaactggatctgcaacccggttcacaaacaccgtgagctcagaggacttacgtcggagggaaagaagaacagaggactgcgtggaaaaggtcacaacaaccacaagaaccgtccctctcgcagagcgacatggaagaagaacaactctctctcccttcgccgttaccgttaa

SEQ ID NO: 950 - protein, 204 aa, Brassica napus
MGAYKYVSELWRKKQSDVMRFVQRVRCWEYRQQPSIVRLVRPTRPDKARRLGYKAKQGFVVYRVRVRRGGRKRPVPKGIVYGKPTNQGVTQLKFQRSKRSVAEERAGRKLGGLRVVNSYWLNEDSTYKYYEIILVDPAHNAVRNDPRINWICNPVHKHRELRGLTSEGKKNRGLRGKGHNNHKNRPSRRATWKKNNSLSLRRYR

SEQ ID NO: 951 - DNA, 1365 bp, Glycine max
  CDS (1)..(1365)
atggaacctcgcgttgggaataagtttcgcctgggtcggaagatcggaagtggctcctttggggagatctatttaggcactaatattcagacaaatgaagaggttgcaattaagcttgaaaatgtcaagacaaaacatcctcaattgctgtatgagtccaagttgtacagaattctccagggaggaactggaattccaaatgtcagatggtttggagtggagggagattacaatgttttagtgatggatctgcttggaccgagtcttgaagatctttttaacttctgcagtagaaagctatcactaaagacagttctcatgcttgctgatcaaatgatcaaccgtgttgagttcattcattcaaaatcgtttctgcatcgggatatcaaaccggataattttctaatgggattaggaaggcgtgcaaaccaggtttatgctattgattttggtttggctaagaaatacagagatagttcaacacatcaacacattccttacagggaaaataagaatttgactggaactgcaaggtatgccagcatgaacactcaccttggcattgaacaaagcagaagagatgatcttgagtctcttggttatgttttgatgtacttcttgagaggaagtcttccttggcagggtcttaaagcgggaacaaagaaacagaagtatgagaaaatcagtgaaaaaaaggtttctacctcgattgaagccttgtgtcgaggttatccaacagaatttgcatcttacttccattactgccgatcattgaggtttgatgataagccagattatgcgtacctcaaaaggatatttcgtgacctgtttattcgtgaaggattccagtttgattatgtctttgactggaccattttgaagtatcagcaatcacagctagccactcctccaacacgggccattggtcctagtgctggaaccagctctggaatgccccccgctgttactaatgctgataggcatacaggaggggaagaaggtagacctcctgctttggtttcagtggattcctcgaggcgcagaatgtcagggcccattttaaatactttatcaagtgccaatgccttgggtcagtcaagtggatcatctaggagggttgctgtctctagtagccgtgatgcatttgttggtgctgagtcagatatccgtactcgcactgctgaggctagccctggagcagcacatcgagctttgagtgggcaaagaagttctccaattggatcttctgatcctaagagagttgtatcatcagggagaaatgcttctcatgtgaaaaattatgacactgcacttaggggcatggaaggtttgcaattagaaaatgatgagaggacccattattaa

SEQ ID NO: 952 - protein, 454 aa, Glycine max
MEPRVGNKFRLGRKIGSGSFGEIYLGTNIQTNEEVAIKLENVKTKHPQLLYESKLYRILQGGTGIPNVRWFGVEGDYNVLVMDLLGPSLEDLFNFCSRKLSLKTVLMLADQMINRVEFIHSKSFLHRDIKPDNFLMGLGRRANQVYAIDFGLAKKYRDSSTHQHIPYRENKNLTGTARYASMNTHLGIEQSRRDDLESLGYVLMYFLRGSLPWQGLKAGTKKQKYEKISEKKVSTSIEALCRGYPTEFASYFHYCRSLRFDDKPDYAYLKRIFRDLFIREGFQFDYVFDWTILKYQQSQLATPPTRAIGPSAGTSSGMPPAVTNADRHTGGEEGRPPALVSVDSSRRRMSGPILNTLSSANALGQSSGSSRRVAVSSSRDAFVGAESDIRTRTAEASPGAAHRALSGQRSSPIGSSDPKRVVSSGRNASHVKNYDTALRGMEGLQLENDERTHY

SEQ ID NO: 953 - DNA, 414 bp, Brassica napus
  CDS (1)..(414)
atgaaaggcggccaatcgaaagcagaagcaacgagcacagatcaaagactcaaaaccagaggaaggaagaagaagacggcgacgaaggacccaaacaaacctaagagacctccaagcgctttcttcgtcttcttagataattttcgacgggagttcaaagaggcgaaccctaacaacaagtccgtagccgccgttgggaaggctgctggagccaagtggaagtctatgagtgaagaagagaaagctccttatgctaccaaggcagagaccaggaagagtgaatataataagagtatgcaacagtacaacatgaaactggctaatggaaccagtagaggtgaagatgatgagtccaagtctgaagttgacgaagctggaggagcaagcgaagaggaggaagaagacgatgattaa

SEQ ID NO: 954 - protein, 137 aa, Brassica napus
MKGGQSKAEATSTDQRLKTRGRKKKTATKDPNKPKRPPSAFFVFLDNFRREFKEANPNNKSVAAVGKAAGAKWKSMSEEEKAPYATKAETRKSEYNKSMQQYNMKLANGTSRGEDDESKSEVDEAGGASEEEEEDDD

SEQ ID NO: 955 - DNA, 1422 bp, Brassica napus
  CDS (1)..(1422)
atgccgagagaaataataacgctgcaagtgggacaatgcgggaaccagatcgggatggagttctggaaacagctttgcctcgagcacggcatcagtaaagacggtatcctcgaagacttcgctactcagggaggtgatagaaaagatgtgtttttttaccaagcggatgaccaacactacatcccacgagcgcttctgattgatttggagcctagagttatcaatgggattcagaacggggactaccggaatctctacaaccatgagaacatcttcgttgctgaccacggtggtggtgctggaaacaactgggccagtggttatcaccaggggaaaggggttgaagaggaaataatggacatgattgatcgagaagctgatggaagtgacagccttgagggttttgttctttgccattccattgctggtggcactggctcaggtatgggctcttacctactggagactctgaacgaccgctacagcaagaagctggttcagacatatagcgtcttccccaaccagatggaaacaagtgatgtagttgtccagccctacaattccctcctcacactgaaacgcctcaccttaaacgctgactgcgtcgtcgtcctcgacaacaccgcgttgactagaatcgccgtggagcgcctccatctcaccaaccccaccttcgctcaaacgaattcgctagtctcaaccgtgatgtccgccagcacaacgacgctgcgttatcctggatacatgaacaacgacttggttggcttgcttgcgtctctgatcccgacgccgaggtgccacttcctcatgacgggttatactccgctgaccgttgagcgccaggcgaatgtcattcgtaagacaaccgtgctggatgtcatgaggaggctcctgcagccgaagaatgtgatggtgtcgtcttatgctaggaacaaggaagctagtcaggcgaagtacatatcaatcttgaatattattcaaggagaagtcgatcccactcaggtgcatgagagtttgcagaggatacgagaaaggaagctcgttaacttcattgaatggggacctgcaagcatacaggttgcactttccaagaagtctccatatgttcaaactgcccatagggtcagtggtcttatgttagcaagccacacaagtataaggcaccttttcagcaaatgtttgagccaatatgataaactgaggaagaagcaagcttttcttgacaattaccgaaagtttcccatgtttgacaatgatctctcagagtttgatgaagcaagagacatcattgagagtttggtagatgagtacaaggcctgtgaatctccagattacatcaaatgggggatggaggatcctgaacagcttgtaactggtgaaggcaatgcttctggtgttgtggatcctaggatggcgttctaa

SEQ ID NO: 956 - protein, 473 aa, Brassica napus
MPREIITLQVGQCGNQIGMEFWKQLCLEHGISKDGILEDFATQGGDRKDVFFYQADDQHYIPRALLIDLEPRVINGIQNGDYRNLYNHENIFVADHGGGAGNNWASGYHQGKGVEEEIMDMIDREADGSDSLEGFVLCHSIAGGTGSGMGSYLLETLNDRYSKKLVQTYSVFPNQMETSDVVVQPYNSLLTLKRLTLNADCVVVLDNTALTRIAVERLHLTNPTFAQTNSLVSTVMSASTTTLRYPGYMNNDLVGLLASLIPTPRCHFLMTGYTPLTVERQANVIRKTTVLDVMRRLLQPKNVMVSSYARNKEASQAKYISILNIIQGEVDPTQVHESLQRIRERKLVNFIEWGPASIQVALSKKSPYVQTAHRVSGLMLASHTSIRHLFSKCLSQYDKLRKKQAFLDNYRKFPMFDNDLSEFDEARDIIESLVDEYKACESPDYIKWGMEDPEQLVTGEGNASGVVDPRMAF

SEQ ID NO: 957 - DNA, 702 bp, Glycine max
  CDS (1)..(702)
atggatcagaaggtcgatttcagcgctccccattccatgggaaccactatcatcggcgttacttacaacggcggtgtcgttctcggagccgactctcgaaccagcaccggagtgtatgttgccaaccgagcatcggacaaaatcactcagctcactgataatgtatacgtgtgtcgctctggatcggctgctgattctcagattgtctctgattatgtgcgttacttcctccatcaacacacaatacaacttggacaacctgcaacagttaaagttgctgcaaaccttgtccgacttctctcatataacaataagaatttcttagagaccgggttaattgttggtggatgggataaatatgaaggtggacaaatttatggagttcctctgggtggaacaatagtacaacaaccttttgctatcggaggatctggctccagttacttgtatggtttctttgaccaagcctggaaagagggaatgaccaaggatgaagctgaggatttagtaaaaaaggctgtttcactggctattgctcgtgatggtgcaagtggtggggttgtccgaacagtcataataaactcagagggagtgaccaggaatttctaccctggcgaccaacttccattatggcacgaggaaatggagccccacaactccttgctagacattcttggtgccccagagccgatgagcatgtga

SEQ ID NO: 958 - protein, 233 aa, Glycine max
MDQKVDFSAPHSMGTTIIGVTYNGGVVLGADSRTSTGVYVANRASDKITQLTDNVYVCRSGSAADSQIVSDYVRYFLHQHTIQLGQPATVKVAANLVRLLSYNNKNFLETGLIVGGWDKYEGGQIYGVPLGGTIVQQPFAIGGSGSSYLYGFFDQAWKEGMTKDEAEDLVKKAVSLAIARDGASGGVVRTVIINSEGVTRNFYPGDQLPLWHEEMEPHNSLLDILGAPEPMSM

SEQ ID NO: 959 - DNA, 411 bp, Glycine max
  CDS (1)..(411)
atggcacgaaccaagcaaacagcgcgcaagtccaccggcggcaaggctcctcggaagcagctcgccacaaaagccgctagaaagtccgctccggcaaccggcggagtaaaaaagccgcaccgttttaggcccggcacggtggcgctgagggagatccgaaagtaccagaagagcacggaacttctgatccggaagctcccgttccagcggctggtgcgcgagatcgcacaggatttcaaaaccgatttgcggtttcagagtagcgctgtttccgcgcttcaggaagcggcggaggcttatttggttgggttgtttgaggatactaatctttgtgccattcacgcaaagcgcgtcaccatcatgcctaaggatattcaacttgcaaggaggatcaggggcgagagggcttga

SEQ ID NO: 960 - protein, 136 aa, Glycine max; identical to SEQ ID NO: 864

SEQ ID NO: 961 - DNA, 1293 bp, Brassica napus
  CDS (1)..(1293)
atggaggctcgtgtggggaacaagtttcgtctcggacgcaaaatcgggagcggttcttttggagagatccatctcggtactcatcttcaaacgaatgaagaagtcgccatcaagcttgaaaatgccaagacaaaacatccacagctgctttatgaatccaagttatacagacttctacagggaggaactggtgttccaaatctcaagtggtttggtgttgaaggcgactacaatgttctggtcatggatttacttggacctagtcttgaagacttgttcaatttctgtagcaggaaactttctctcaagtccgtcctcatgcttgctgatcaaatgataaaccgtgttgagtatttccattcgaaatctttcctccaccgagatctcaagcctgacaacttcctcatggggttagggagacgcgccaaccaggtatacatcatcgactttggtcttgcaaagaagtacagagataacactactcatcagcacattccttaccgagaaaacaagaatctcactggaactgcaagatatgctagtatgaacactcacttgggaattgaacaaagcagaagggatgacttagaatctcttggttacattctcatgtatttccttaaaggaagtcttccatggcaagggcttaaagctggaaccaagaaacaaaaatatgagagaatcagcgaaaagaaagtctctacatccattgagtccttatgccgtggctacccatctgagttcgcatcctacttccattactgccgctccctccggtttgatgataaaccagattacggttacctcaaaagaatattcagagatctcttcatccgcgaagggtttcaattcgattatgtctttgactggaccatactgaagtaccaacagtcacagctaacagctcctccaacacgtggccctgcggctggaaccagttcgggtttgtctccaggattgaccagcactgatagatacggagaggaagatggagggagaccaccgatggattcatcaagaaggagaacatcaggagctctcgagaactcatcagctgctgttagagctccaatgatgccaagctcgtcgctgttcggacaatcagcaggatcatcgaggagagtaacgtctgaggagctgcagagaagccgtacgggcagtggattgagaaactctgggatggtttcaacgtcggagaggaagagatcttcttccactaggaaacaatatgattctgctatcaaaggcattgagactctccatgtctctgacgaaaggtatcaccaccattga

SEQ ID NO: 962 - protein, 430 aa, Brassica napus
MEARVGNKFRLGRKIGSGSFGEIHLGTHLQTNEEVAIKLENAKTKHPQLLYESKLYRLLQGGTGVPNLKWFGVEGDYNVLVMDLLGPSLEDLFNFCSRKLSLKSVLMLADQMINRVEYFHSKSFLHRDLKPDNFLMGLGRRANQVYIIDFGLAKKYRDNTTHQHIPYRENKNLTGTARYASMNTHLGIEQSRRDDLESLGYILMYFLKGSLPWQGLKAGTKKQKYERISEKKVSTSIESLCRGYPSEFASYFHYCRSLRFDDKPDYGYLKRIFRDLFIREGFQFDYVFDWTILKYQQSQLTAPPTRGPAAGTSSGLSPGLTSTDRYGEEDGGRPPMDSSRRRTSGALENSSAAVRAPMMPSSSLFGQSAGSSRRVTSEELQRSRTGSGLRNSGMVSTSERKRSSSTRKQYDSAIKGIETLHVSDERYHHH

SEQ ID NO: 963 - DNA, 270 bp, Oryza sativa
  CDS (1)..(270)
atgtctcagaacaacccctcccagctcctcccctcagagctgattgaccgctgcatcgggtccaagatttgggtgattatgaagggtgacaaggagctcgtcggcactctctgtgggttcgatgtgtacgtcaacatggtgctcgaggacgttactgagtatgaatacactgctgaaggccgtcgcataacaaagcttgatcagatactcctaaacggcaacaatatagctattttggttcctggtggttctcccccagatgtggcataa

SEQ ID NO: 964 - protein, 89 aa, Oryza sativa
MSQNNPSQLLPSELIDRCIGSKIWVIMKGDKELVGTLCGFDVYVNMVLEDVTEYEYTAEGRRITKLDQILLNGNNIAILVPGGSPPDVA

SEQ ID NO: 965 - DNA, 411 bp, Glycine max
  CDS (1)..(411)
atggcacgtacgaagcaaactgctcgtaagtccacaggaggaaaggcacctaggaagcagctcgcaaccaaggctgcacgtaagtctgcaccaactactggtggtgtgaagaagccacatcgttatcgtcctggtaccgttgctcttcgtgagattaggaaataccagaagagtaccgagcttttgatcaggaagctccccttccagaggctggttcgtgaaattgctcaggacttcaagactgatctgcgtttccagagccatgctgtgcttgcattgcaagaagctgctgaggcataccttgttggactctttgaggatactaatctgtgtgccattcacgctaagcgtgtaactattatgcccaaagatatccagctggcaagaaggattcgtggtgagcgtgcttga

SEQ ID NO: 966 - protein, 136 aa, Glycine max; identical to SEQ ID NO: 826

SEQ ID NO: 967 - DNA, 666 bp, Glycine max
  CDS (1)..(666)
atgagcaacgtgttcgagggttacgaacgccaatactgcgagctctcggcgaatctagcgaaaaagtgcactgccgctggtgctcttaatggagagcaaaagaaacagaaagtttctgaagtaaaggctggaattgatgaagcagaagctttgattagaaaaatggaccttgaggcaagaagtttacagccaaacatcaagggtgtgcttcttgctaagttgcgagagtataaatcggatctcaacaatcttaaaagtgaagttaagaaaattgtatctggtaacttaaacccttctgcacgggatgaattgttggaatcaggcatggcagatgctatgacggcatctgcagatcagagaacaagattaatggtgtcaactgagaggttgaataagaccagtgatagagttaaggatagtaggagaacaatgttggaaacggaagagcttggtgtctcaattcttcaagatttgcattcacaacgacaatctctattgcatgcacataacacgctccatggagtggatgataacataggcaagagcaagaaaattttgaccaacatgtcaagaaggatgaacaagaacaaatgggttattggtggcattgttttggtcctggttatagctatcatcgtgatcctgtacttcaagttttctaaatag

SEQ ID NO: 968 - protein, 221 aa, Glycine max
MSNVFEGYERQYCELSANLAKKCTAAGALNGEQKKQKVSEVKAGIDEAEALIRKMDLEARSLQPNIKGVLLAKLREYKSDLNNLKSEVKKIVSGNLNPSARDELLESGMADAMTASADQRTRLMVSTERLNKTSDRVKDSRRTMLETEELGVSILQDLHSQRQSLLHAHNTLHGVDDNIGKSKKILTNMSRRMNKNKWVIGGIVLVLVIAIIVILYFKFSK

SEQ ID NO: 969 - DNA, 411 bp, Glycine max
  CDS (1)..(411)
atggctcgaactaagcaaactgctcgcaagtccaccggcggcaaggcgccacgtaagcagttggcgaccaaggccgcccggaagtccgctcccgcgaccggaggagtgaagaagccccaccgcttcaggccgggaaccgtggcgctgagggaaatcagaaagtatcagaagagcaccgagcttctcatcaggaagcttccgtttcagagactcgtgagggaaatcgcgcaggacttcaagaccgatttgcgttttcagagtagcgccgtttctgcgcttcaggaagctgctgaggcctacctcgttgggttgttcgaggacactaacctttgcgcgattcatgcaaagagggttaccattatgcctaaggatattcagcttgctcgcaggatcagaggcgagagggcttag

SEQ ID NO: 970 - protein, 136 aa, Glycine max; identical to SEQ ID NO: 864

SEQ ID NO: 971 - DNA, 612 bp, Oryza sativa
  CDS (1)..(612)
atggcggccaacgccggcaacaagatccgcaacgccaaactggttcttcttggagatgtgggcgcaggaaaatctagcttggtgcttcgttttgtaaaaggacagtttgttgagtttcaggaatcgacaattggagcagcatttttctcacagaccttagcagttaatgacgaaaccgtgaagtttgaaatctgggatacagctgggcaggagagatatcacagcttggctcccatgtactataggggtgcggctgctgccatagttgtctatgacatcacgaatccggcctctttcacccgtgcaaagaaatgggttcaagaacttcaagctcaaggtaactcgagtacagtggtggctcttgctggcaacaaagccgatttgctagagactaggcaggtgcaaatagaggaagcaaagacatatgcacaggagaatgggcttttcttcatggaaacatctgcgaaaactgcaacaaatgtgaatgacatattttatgaaattgcaaaaagattgcttcaaggacagccagctcagaacccgcaggccggcatggtcctctcccagagaccaaatgagagactggtcagctctgcttcatgctgctcttga

SEQ ID NO: 972 - protein, 203 aa, Oryza sativa
MAANAGNKIRNAKLVLLGDVGAGKSSLVLRFVKGQFVEFQESTIGAAFFSQTLAVNDETVKFEIWDTAGQERYHSLAPMYYRGAAAAIVVYDITNPASFTRAKKWVQELQAQGNSSTVVALAGNKADLLETRQVQIEEAKTYAQENGLFFMETSAKTATNVNDIFYEIAKRLLQGQPAQNPQAGMVLSQRPNERLVSSASCCS

SEQ ID NO: 973 - DNA, 411 bp, Oryza sativa
  CDS (1)..(411)
atggctcgcactaagcagaccgcccgcaagtccactggtggcaaggcccctcgcaagcagcttgcatccaaggctgctcgcaagtccgccccatctaccggcggtgtcaagaagcctcaccgttacaagcccggtaccgtcgctctccgtgagattcgtcgctaccagaagagcactgagcttctcatccgcaagctccccttccagcgtcttgtccgtgagattgcccaggacttcaagagcgaccttcgcttccagtcctccgccatcggtgccctccaggagtcagtcgagtcttacctcgtctccctctttgaggataccaacctctgtgccatccacgccaagcgtgtcaccatccagtccaaggacatccagcttgcccgccgccttcgcggcgagcgcaactaa

SEQ ID NO: 974 - protein, 136 aa, Oryza sativa
MARTKQTARKSTGGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQLARRLRGERN

SEQ ID NO: 975 - DNA, 38 bp, Artificial sequence
  Cloning cassette sequence
ttgctcttccatggcaatgattaattaacgaagagcaa

SEQ ID NO: 976 - DNA, 38 bp, Artificial sequence
  Cloning cassette sequence
ggaattccagctgaccaccatggcaattcccggggatc

SEQ ID NO: 977 - DNA, 38 bp, Artificial sequence; identical to SEQ ID NO: 975
  Cloning cassette sequence

The invention claimed is:

1. A transgenic plant or plant cell with increased tolerance and/or resistance to drought stress as compared to a corresponding non-transformed wild type plant or plant cell, wherein the transgenic plant or plant cell is transformed with a nucleic acid molecule comprising a Stress-Related Protein (SRP) coding nucleic acid sequence selected from the group consisting of:
   a) the nucleic acid sequence of SEQ ID NO: 77;
   b) a nucleic acid sequence encoding a polypeptide comprising the amino acid sequence of SEQ ID NO: 78; and
   c) a nucleic acid sequence encoding a polypeptide having at least 95% sequence identity with the amino acid sequence of SEQ ID NO: 78, wherein said polypeptide has the activity of the polypeptide of SEQ ID NO: 78.

2. The transgenic plant or plant cell of claim 1, derived from a monocotyledonous plant.

3. The transgenic plant or plant cell of claim 1, derived from a dicotyledonous plant.

4. The transgenic plant or plant cell of claim 1, wherein the plant is selected from the group consisting of maize, wheat, rye, oat, triticale, rice, barley, soybean, peanut, cotton, rapeseed, canola, manihot, pepper, sunflower, flax, borage, safflower, linseed, primrose, rapeseed, turnip rape, tagetes, solanaceous plants, potato, tobacco, eggplant, tomato, Vicia species, pea, alfalfa, coffee, cacao, tea, Salix species, oil palm, coconut, perennial grass, forage crops and Arabidopsis thaliana.

5. A seed produced by the transgenic plant of claim 1 or a transgenic plant generated from the transgenic plant cell, wherein the seed is genetically homozygous for the SRP coding nucleic acid sequence.

6. A method of producing a transgenic plant with increased tolerance and/or resistance to drought stress compared to a corresponding non transformed wild type plant, comprising:
   a) transforming a plant or plant cell with a nucleic acid molecule comprising a Stress-Related Protein (SRP) coding nucleic acid sequence selected from the group consisting of:
      i) the nucleic acid sequence of SEQ ID NO: 77;
      ii) a nucleic acid sequence encoding a polypeptide comprising the amino acid sequence of SEQ ID NO: 78; and
      iii) a nucleic acid sequence encoding a polypeptide having at least 95% sequence identity with the amino acid sequence of SEQ ID NO: 78, wherein said polypeptide has the activity of the polypeptide of SEQ ID NO: 78;
   b) optionally generating a transgenic plant from the plant cell; and
   c) selecting a transgenic plant with increased tolerance and/or resistance to drought stress as compared to a corresponding non-transformed wild type plant, wherein expression of said isolated nucleic acid molecule in the transgenic plant results in increased tolerance and/or resistance to drought stress as compared to a corresponding non-transformed wild type plant.

7. The method of claim 6, wherein the isolated nucleic acid molecule comprises the nucleotide sequence of SEQ ID NO: 77 or a nucleic acid sequence encoding a polypeptide comprising the amino acid sequence of SEQ ID NO: 78.

8. A method of modifying stress tolerance of a plant comprising, increasing expression level of a Stress-Related Protein (SRP) coding nucleic acid in a plant, wherein the SRP coding nucleic acid comprises:
   a) the nucleic acid sequence of SEQ ID NO: 77;
   b) a nucleic acid sequence encoding a polypeptide comprising the amino acid sequence of SEQ ID NO: 78; or
   c) a nucleic acid sequence encoding a polypeptide having at least 95% sequence identity with the amino acid sequence of SEQ ID NO: 78, wherein said polypeptide has the activity of the polypeptide of SEQ ID NO: 78.

9. The method of claim 8, wherein the expression level of a Stress-Related Protein (SRP) coding nucleic acid is increased by transforming the plant with an expression vector comprising the SRP coding nucleic acid.

* * * * *